(12) United States Patent
Madani et al.

(10) Patent No.: US 12,123,016 B1
(45) Date of Patent: Oct. 22, 2024

(54) NUCLEASES AND COMPOSITIONS, SYSTEMS, AND METHODS THEREOF

(71) Applicant: Profluent Bio Inc., Berkeley, CA (US)

(72) Inventors: Ali Madani, Berkeley, CA (US); Jeffrey A. Ruffolo, Berkeley, CA (US); Stephen Nayfach, Berkeley, CA (US); Aadyot Bhatnagar, Berkeley, CA (US); Joel Beazer, Berkeley, CA (US)

(73) Assignee: Profluent Bio Inc., Berkeley, CA (US)

( * ) Notice: Subject to any disclaimer, the term of this patent is extended or adjusted under 35 U.S.C. 154(b) by 0 days.

(21) Appl. No.: 18/623,883

(22) Filed: Apr. 1, 2024

Related U.S. Application Data

(60) Provisional application No. 63/627,457, filed on Jan. 31, 2024.

(51) Int. Cl.
*C12N 15/90* (2006.01)
*C12N 9/22* (2006.01)
*C12N 15/11* (2006.01)

(52) U.S. Cl.
CPC ............. *C12N 15/907* (2013.01); *C12N 9/22* (2013.01); *C12N 15/11* (2013.01); *C12N 2310/20* (2017.05); *C12N 2800/80* (2013.01)

(58) Field of Classification Search
None
See application file for complete search history.

(56) References Cited

U.S. PATENT DOCUMENTS 5,034,506 A    7/1991   Summerton

FOREIGN PATENT DOCUMENTS

WO    WO-2023102329 A2 *   6/2023

OTHER PUBLICATIONS

Altschul et al., "Basic local alignment search tool" J Mol Biol. Oct. 5, 1990; 215(3):403-10.
Altschul et al., "Gapped BLAST and PSI-BLAST: a new generation of protein database search programs" Nucleic Acids Res., 1997, 25(17): 3389-3402.
Ausubel et al., Current Protocols in Molecular Biology, John Wiley & Sons, New York, 1989.
Beigert et al., f Proc. Natl. Acad. Sci. USA, 2009, 106(10): 3770-3775.
Braasch & Corey, "Novel antisense and peptide nucleic acid strategies for controlling gene expression" Biochemistry, 2002, 41(14): 4503-4510.
Gaudelli et al. "Directed evolution of adenine base editors with increased activity and therapeutic application" Nature Biotechnology, 2000, 38:892-900.
Gelinas et al., "Embracing proteins: structural themes in aptamer-protein complexes" Current Opinion in Structural Biology, 2016, 36: 122-132.
Hasegawa, "Methods for Improving Aptamer Binding Affinity" Molecules, 2016, 21(4): 421.
Heigwer et al. "E-CRISP: fast CRISPR target site identification" Nat Methods, 2014, 11(2): 122-123.
Hsiau et al., "Inference of CRISPR Edits from Sanger Trace Data" bioRxiv 251082; 2019, doi: https://doi.org/10.1101/251082.
Ibraheem et al., "Gene therapy and DNA delivery systems" Int J Pharm., 2014, 459(1-2):70-83.
Jayasena, "Aptamers: an emerging class of molecules that rival antibodies in diagnostics" Clinical Chemistry. 1999, 45(9): 1628-1650.
Jinek et al., "A Programmable Dual-RNA-Guided DNA Endonuclease in Adaptive Bacterial Immunity" Science, 2012, 337(6096): 816-821.
Kaufman et al., "Translational efficiency of polycistronic mRNAs and their utilization to express heterologous genes in mammalian cells" EMBO J. 1987, 6:187-193.
Kay et al., "Viral vectors for gene therapy: the art of turning infectious agents into vehicles of therapeutics" Nat. Medic. 2001, 7(1):33-40.
Klein et al., "High-velocity microprojectiles for delivering nucleic acids into living cells" Nature, 1987, 327:70-73.
Lehninger, Principles of Biochemistry, 793-800 (Worth Pub. 1982).
Nayerossadat et al. "Viral and nonviral delivery systems for gene delivery" Adv Biomed Res. 2012; 1: 27.
Noguchi et al., "PDX-1 Protein Containing Its Own Antennapedia-Like Protein Transduction Domain Can Transduce Pancreatic Duct and Islet Cells" Diabetes 2003, 52(7):1732-1737.
Prykhozhij et al., "CRISPR MultiTargeter: A Web Tool to Find Common and Unique CRISPR Single Guide RNA Targets in a Set of Similar Sequences" PLOS One 10(9): e0138634.
Ran et al., "Genome engineering using the CRISPR-Cas9 system" Nature Protocols, 2013, 8:2281-2308.
Seed, "An LFA-3 cDNA encodes a phospholipid-linked membrane protein homologous to its receptor CD2" Nature 1987, 329:840-842.
Sharei et al., "A vector-free microfluidic platform for intracellular delivery" Proc. Natl. Acad. Sci. USA, 2013, 110(6): 2082-2087.
Soding, "Protein homology detection by HMM-HMM comparison" Bioinformatics, 2005, 21(7): 951-60.
Trehin et al. "Cellular Uptake But Low Permeation of Human Calcitonin-Derived Cell Penetrating Peptides and Tat(47-57) Through Well-Differentiated Epithelial Models" Pharm. Research, 2004, 21:1248-1256.
Wahlestedt et al., "Potent and nontoxic antisense oligonucleotides containing locked nucleic acids" Proc. Natl. Acad. Sci. U.S.A., 2000, 97:5633-5638.
Walther & Stein, "Viral vectors for gene transfer: a review of their use in the treatment of human diseases" Drugs. Aug. 2000; 60(2):249-71.
Wang et al., "Cyclohexene Nucleic Acids (CeNA): Serum Stable Oligonucleotides that Activate RNase H and Increase Duplex Stability with Complementary RNA" J. Am. Chem. Soc. 2000, 122, 36, 8595-8602.

(Continued)

*Primary Examiner* — Daniel E Kolker
*Assistant Examiner* — Maureen Varina Driscoll
(74) *Attorney, Agent, or Firm* — Casimir Jones, S.C.; Kelly A. Barton

(57) ABSTRACT

The present disclosure provides components, compositions, methods, and systems thereof for nucleic acid editing. Particularly, the disclosure provides engineered nucleases, fusion proteins of the engineered nucleases, systems including the engineered nucleases, and methods of using thereof.

30 Claims, 10 Drawing Sheets
Specification includes a Sequence Listing.

(56) References Cited

OTHER PUBLICATIONS

Wender et al. "The design, synthesis, and evaluation of molecules that enable or enhance cellular uptake: Peptoid molecular transporters" Proc. Natl. Acad. Sci. USA 2000, 97:13003-13008.
Xiao et al. "CasOT: a genome-wide Cas9/gRNA off-target searching tool" Bioinformatics 2014, 30(8): 1180-1182.
Xu et al. "BEAT: A Python Program to Quantify Base Editing from Sanger Sequencing" The CRISPR Journal, 2019, vol. 2, No. 4, 7 pages.
Zender et al., "VP22-mediated intercellular transport of p53 in hepatoma cells in vitro and in vivo" Cancer Gene Ther. 2002, 9(6):489-96.
Zhu et al., "Overview of guide RNA design tools for CRISPR-Cas9 genome editing technology" Frontiers in Biology, 2015, 10(4): 289-296.
Zhu et al., "The Relationship of Retinal Vessel Diameters and Fractal Dimensions with Blood Pressure and Cardiovascular Risk Factors" PLOS One, 2014, 9(9): e106551.

\* cited by examiner

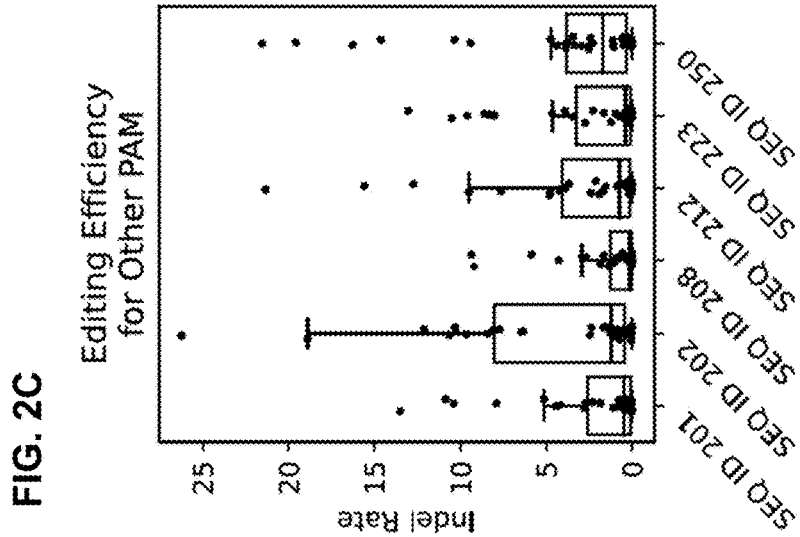
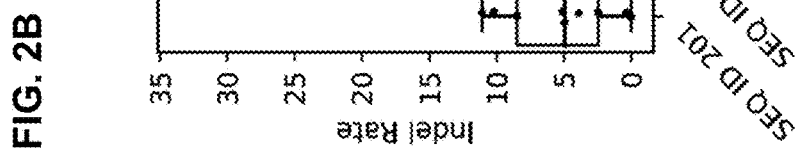
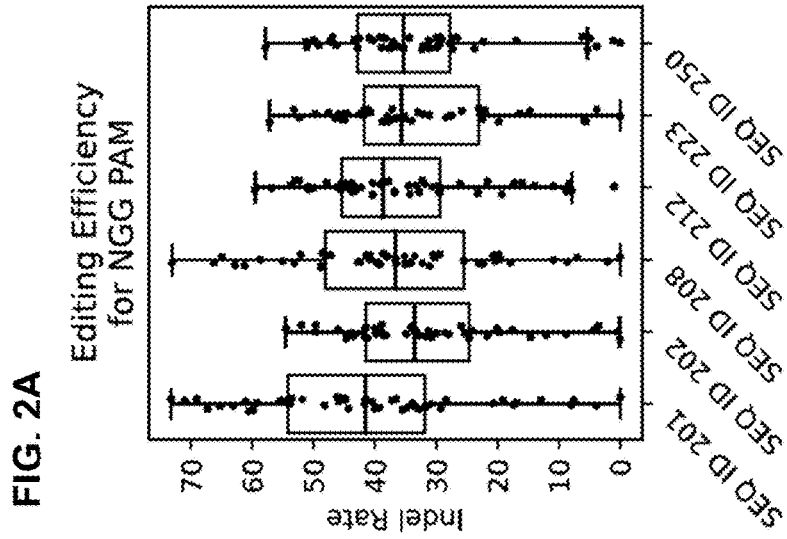

NUCLEASES AND COMPOSITIONS, SYSTEMS, AND METHODS THEREOF

FIELD

The present disclosure relates to components, compositions, methods, and systems thereof for nucleic acid editing. Particularly, the disclosure relates to engineered nucleases, fusion proteins of the engineered nucleases, systems including the engineered nucleases, and methods of using thereof.

CROSS-REFERENCE TO RELATED APPLICATIONS

This application claims the benefit of U.S. Provisional Application No. 63/627,457, filed Jan. 31, 2024, the content of which is herein incorporated by reference in its entirety.

SEQUENCE LISTING STATEMENT

The content of the electronic sequence listing titled PROF_42580_203_SequenceListing.xml (Size: 841,404 bytes; and Date of Creation: Apr. 1, 2024) is herein incorporated by reference in its entirety.

BACKGROUND

Methods for precisely and efficiently editing nucleic acid sequences, particularly in vivo, are challenging to develop but when successful enable studies of gene function and open doors to new therapies for human genetic diseases. Over the past few decades, development in the use of nucleases, including meganucleases (MNs), zinc figure nucleases (ZFNs), Transcription Activator-Like Effector Nucleases (TALENs), and Clustered Regularly Interspaced Short Palindromic Repeats (CRISPR) associated (Cas) nucleases, has enabled modification of specific DNA sequences within cells, both eukaryotic and prokaryotic. However, there is a continuing need to expand the available nucleases which are efficient, precise, and suitable for use in genetic engineering methods and therapies, particularly in eukaryotic cells and organisms.

SUMMARY

Provided herein are engineered nucleases. In some embodiments, the engineered nucleases have an amino acid sequence with at least 75% identity to any of SEQ ID NOs: 1-304. In some embodiments, the engineered nucleases have an amino acid sequence with at least 90% identity to any of SEQ ID NOs: 1-304. In some embodiments, the engineered nucleases have an amino acid sequence of any of SEQ ID NO: 1-304.

In some embodiments, the engineered nucleases comprise an amino acid sequence having at least 75% identity to any one of SEQ ID NOs: 201, 202, 208, 212, 223, and 250. In some embodiments, the engineered nucleases have an amino acid sequence with at least 90% identity to any of SEQ ID NOs: 201, 202, 208, 212, 223, and 250. In some embodiments, the engineered nucleases comprise an amino acid sequence of any one of SEQ ID NOs: 201, 202, 208, 212, 223, and 250.

In some embodiments, the engineered nucleases have one or more amino acid substitutions configured to fully or partially catalytically inactivate the engineered nuclease.

In some embodiments, the engineered nucleases further comprise a localization sequence, a tag sequence, a protein transduction domain sequence, or a combination thereof.

Also provided herein are fusion proteins comprising an engineered nuclease as described herein and one or more effector domains. In some embodiments, the one or more effector domains are each individually selected from the group consisting of: a transcription activator, a transcription repressor, a deaminase, a polymerase, an epigenetic modifier, and a detection agent. In some embodiments, the engineered nuclease has one or more amino acid substitutions configured to fully or partially catalytically inactivate the engineered nuclease.

Further provided are nucleic acids (e.g., vectors) encoding an engineered nuclease or fusion protein as described herein.

Additionally provided are systems comprising an engineered nuclease or fusion protein as described herein. In some embodiments, the systems further comprise at least one guide RNA. In some embodiments, at least one gRNA is complexed with the engineered nuclease.

Compositions and cells comprising an engineered nuclease, a fusion protein, a nucleic acid, a vector, or a system as disclosed herein are also provided. In some embodiments, the compositions further comprise a carrier. In some embodiments, the cell is a prokaryotic cell or a eukaryotic cell. In some embodiments, the cell is a mammalian cell. In some embodiments, the cell is a human cell.

Methods of modifying a target nucleic acid are likewise provided. In some embodiments, the methods comprise contacting the target nucleic acid with an engineered nuclease, a fusion protein, a nucleic acid, a vector, or a system as described herein.

In some embodiments, the target nucleic acid is associated with a disease or disorder.

In some embodiments, the target nucleic acid encodes a gene product. In some embodiments, the target nucleic acid is a disease-associated gene.

In some embodiments, the target nucleic acid is in a cell. In some embodiments, the contacting comprises introducing into the cell. In some embodiments, the cell is in vitro or ex vivo. In some embodiments, the cell is in vivo. In some embodiments, the introducing comprises administering to a subject.

In some embodiments, the cell is in a plant. In some embodiments, the method comprises administering to a plant, plant cell, seed, fruit, plant part, or propagation material of a plant the polypeptide, fusion protein, nucleic acid, vector, or system.

In some embodiments, the methods treat a disease or disorder in a subject. In some embodiments, the methods comprise administering to the subject in need thereof an effective amount of an engineered nuclease, a fusion protein, a nucleic acid, a vector, or a system as described herein. In some embodiments, the subject is a human. In some embodiments, the target nucleic acid is a disease-associated gene. In some embodiments, the target nucleic acid encodes a gene product.

Other aspects and embodiments of the disclosure will be apparent in light of the following detailed description.

BRIEF DESCRIPTION OF THE DRAWINGS

FIGS. 2A-2C are graphs of the editing efficiency as shown based on indel rates for the indicated engineered nucleases using a target having an NGG PAM sequence (FIG. 2A), a NAG PAM sequence (FIG. 2B), or another PAM sequence (FIG. 2C).

DETAILED DESCRIPTION

Figure 1A:
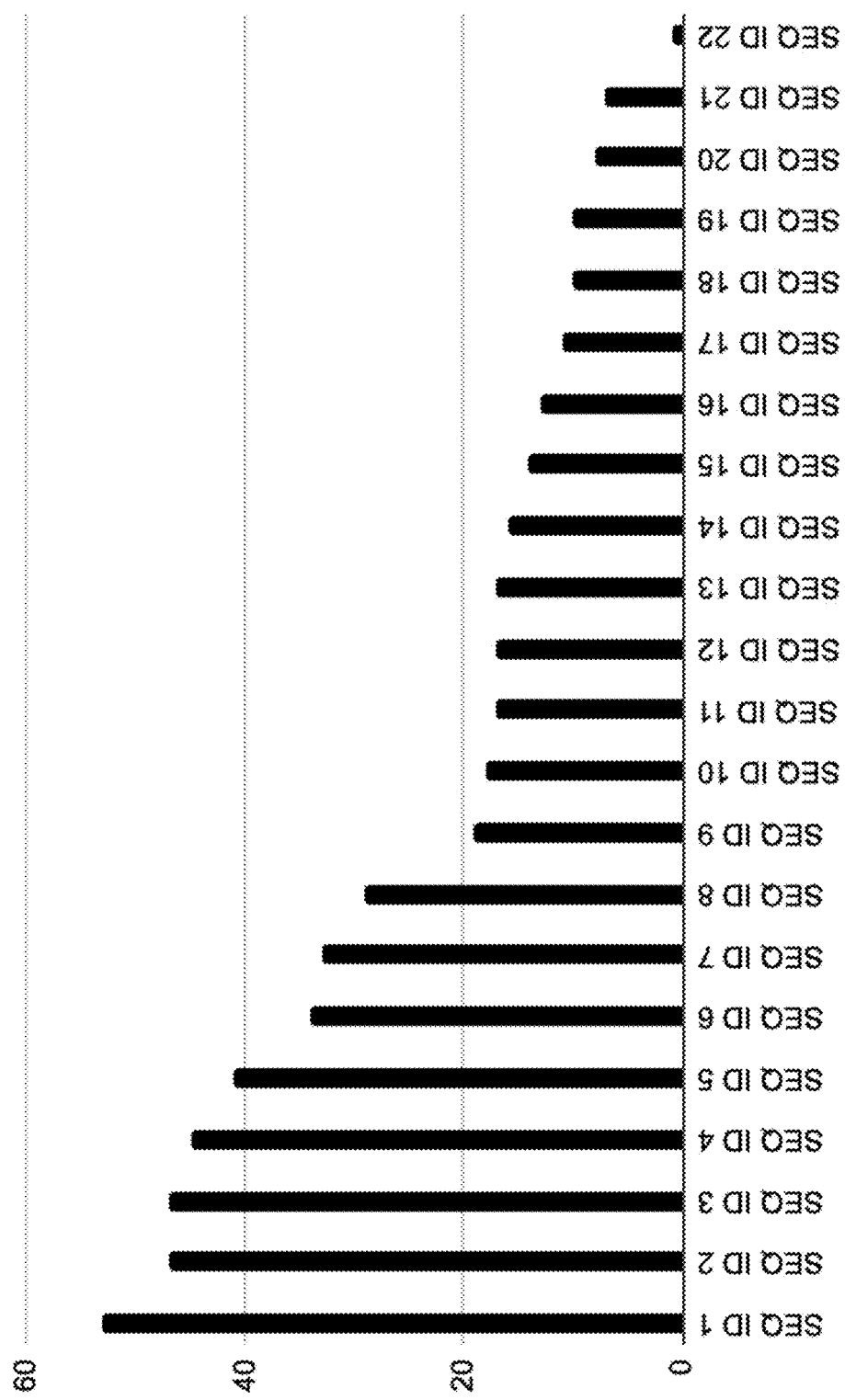
FIGS. 1A-1C are graphs of the editing efficiency in HEK 293 cells as determined from Sanger sequencing data and the Inference of CRISPR Edits program (ICE) for selected engineered nucleases, as disclosed herein, using the indicated guide RNAs.
Figure 1B:
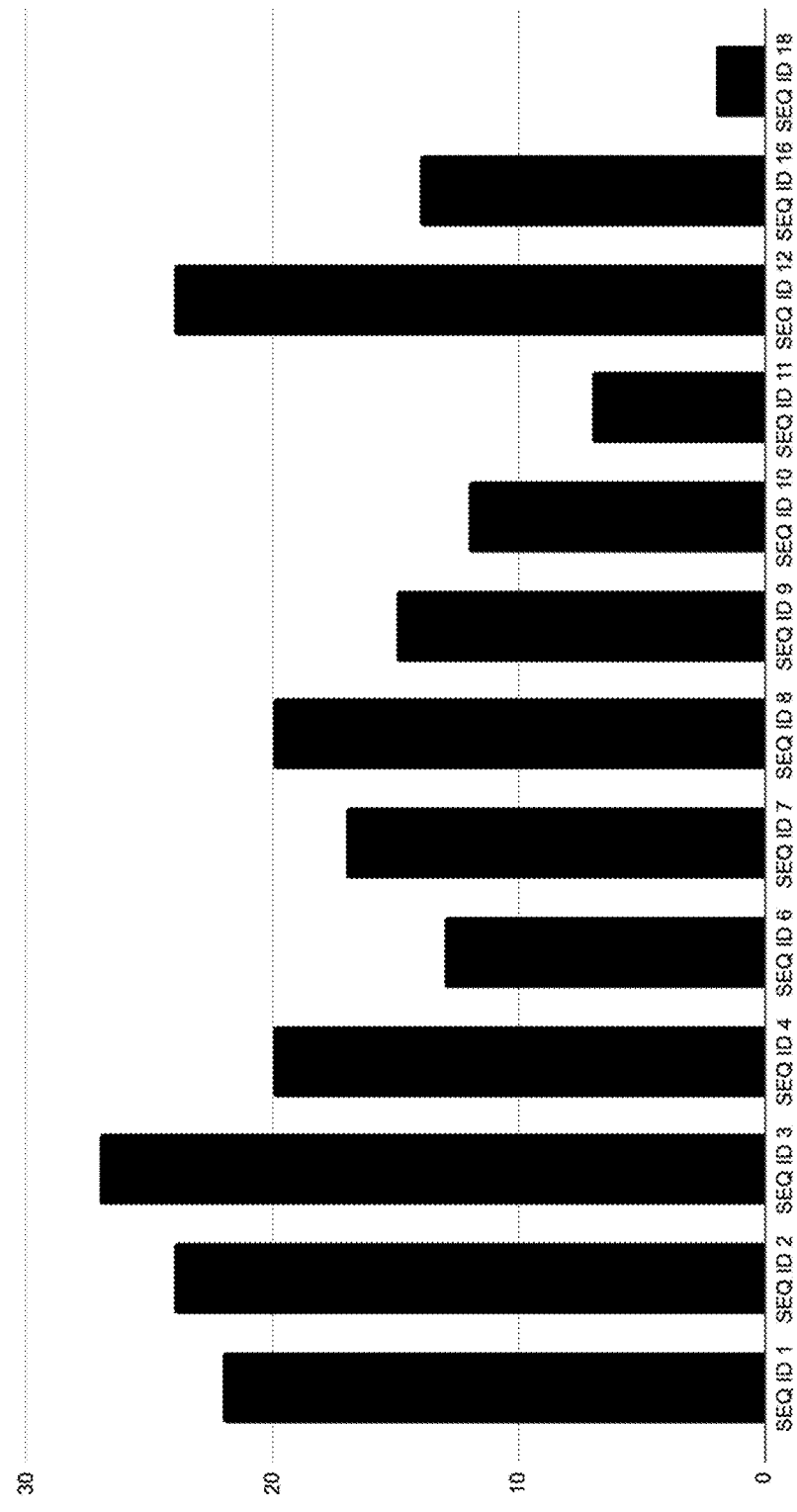
Figure 1C:
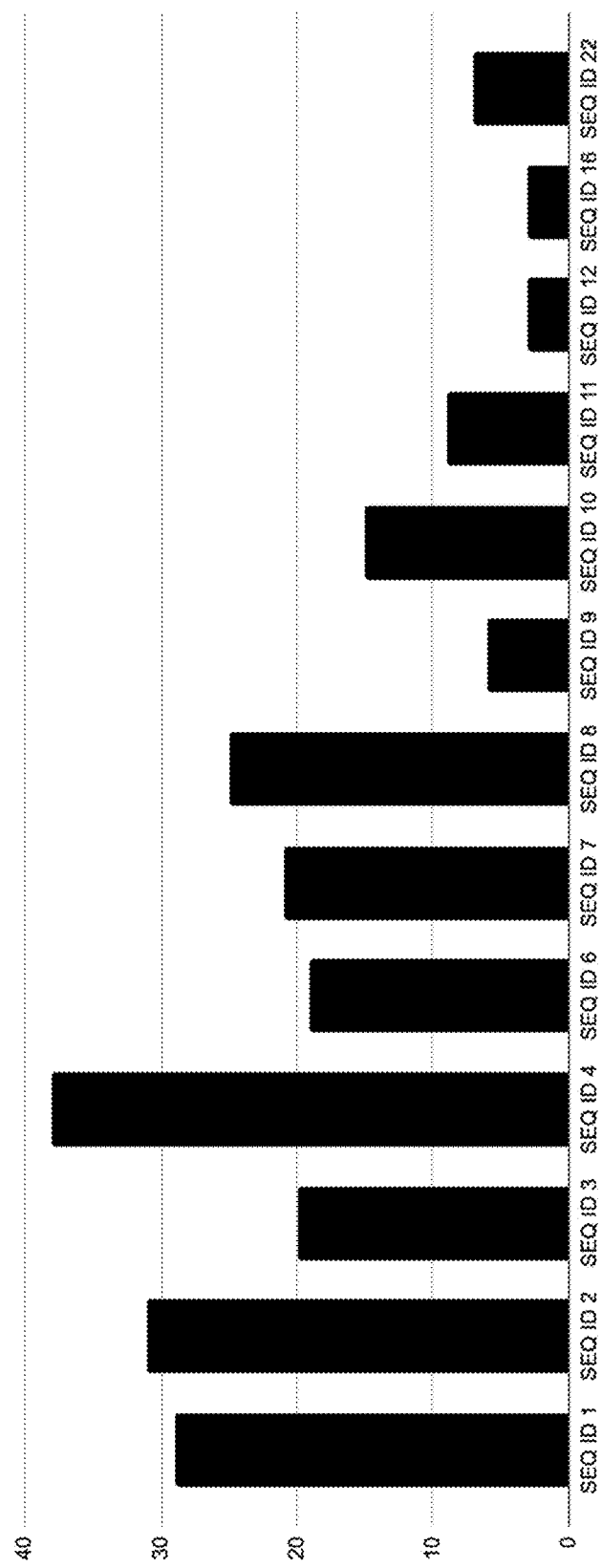
Figure 3A:
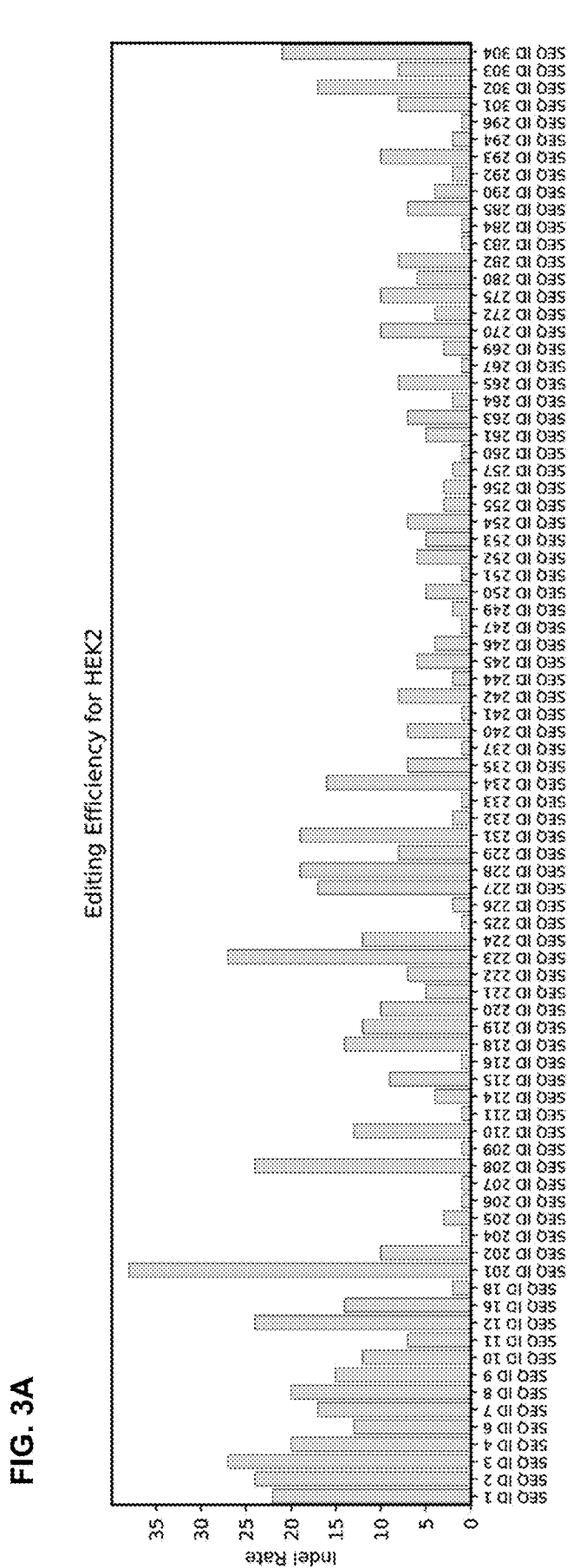
FIGS. 3A-3C are graphs of the editing efficiency based on indel rates for the indicated engineered nucleases at three different target sites HEK2 (FIG. 3A), HEK3 (FIG. 3B), and CD3G_1 (FIG. 3C).
Figure 3B:
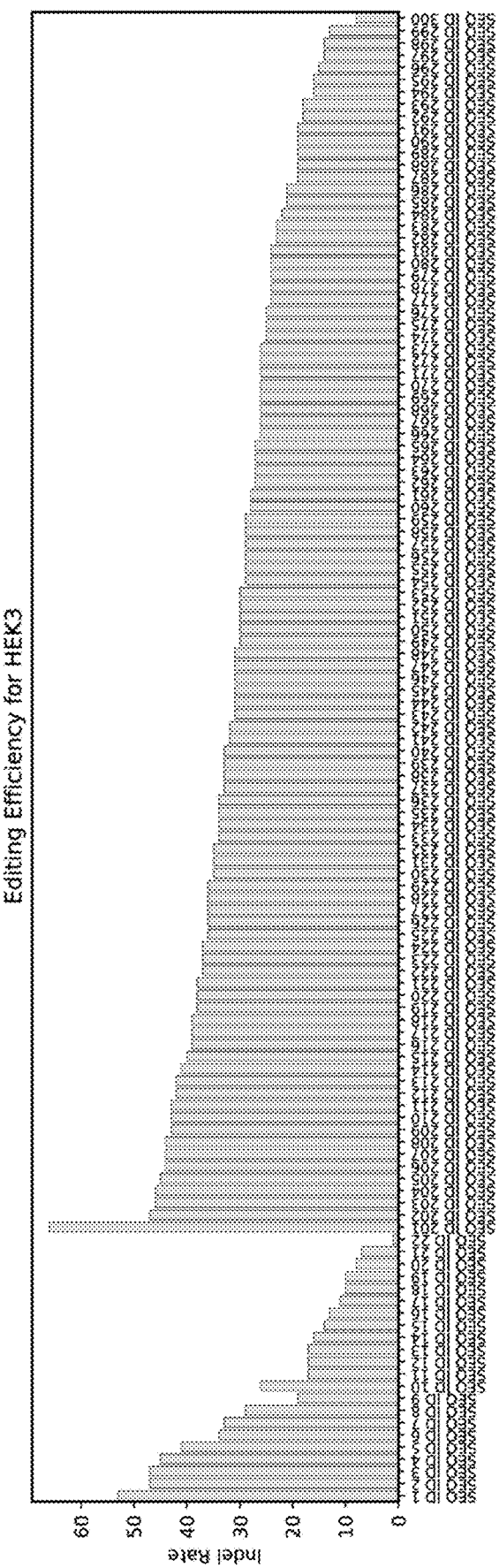
Figure 3C:
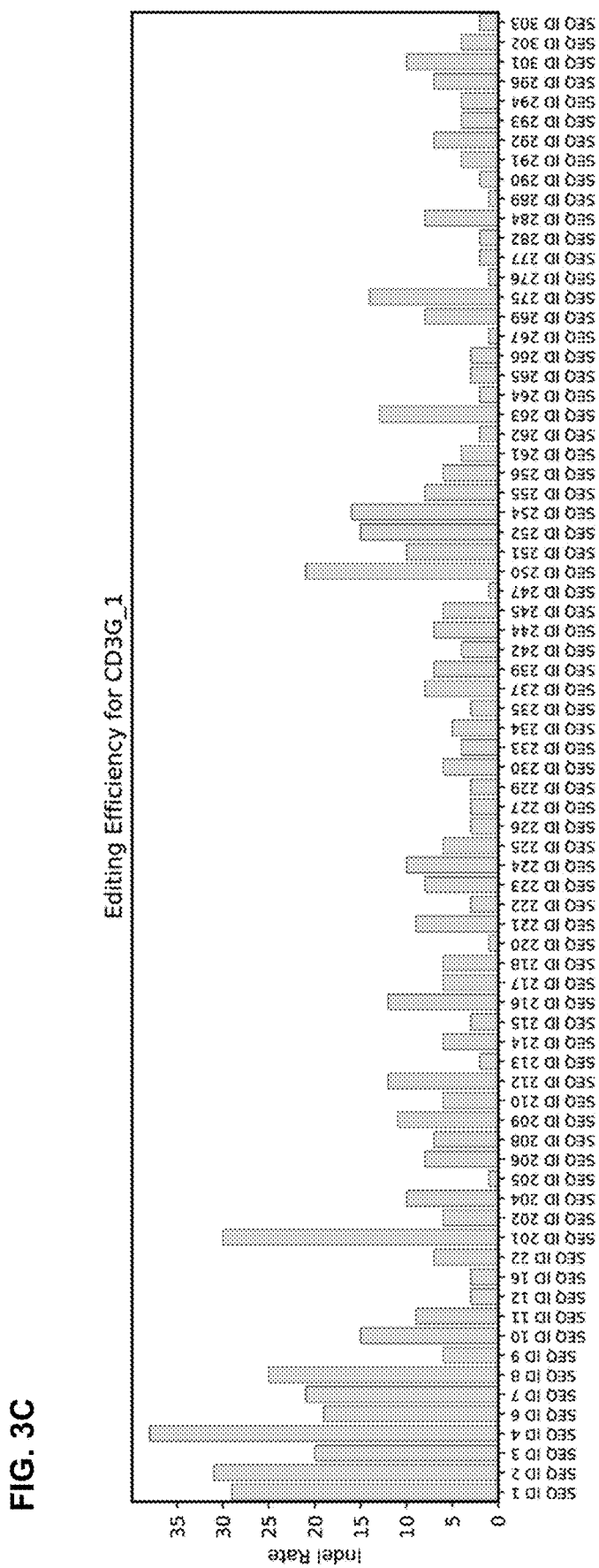
Figure 4:
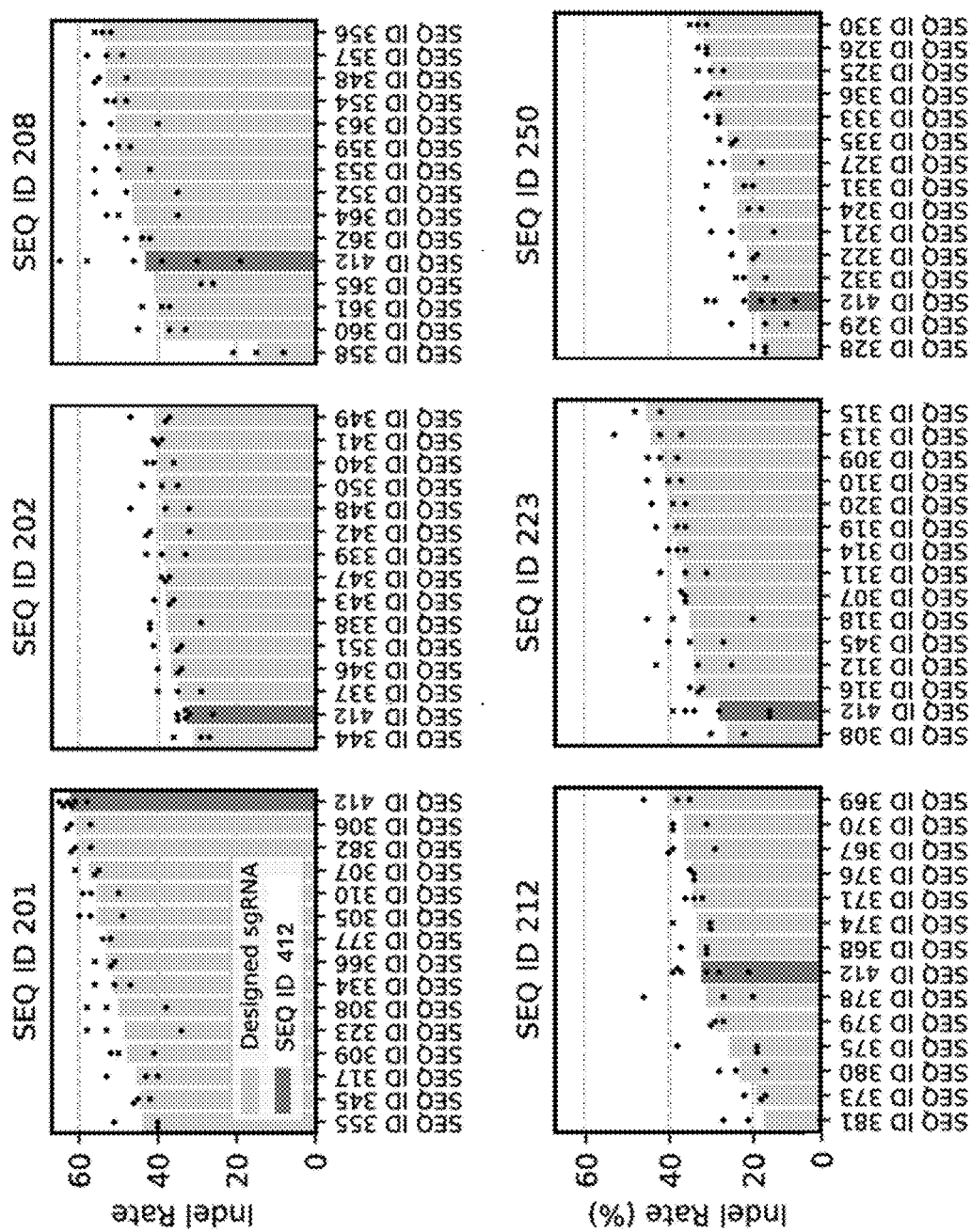
FIG. 4 is a graph of editing efficiency based on indel rates for the indicated engineered nucleases using the indicated synthetic gRNAs as compared to SEQ ID NO: 412 (dark grey) at the HEK3 target site.
Figure 5:
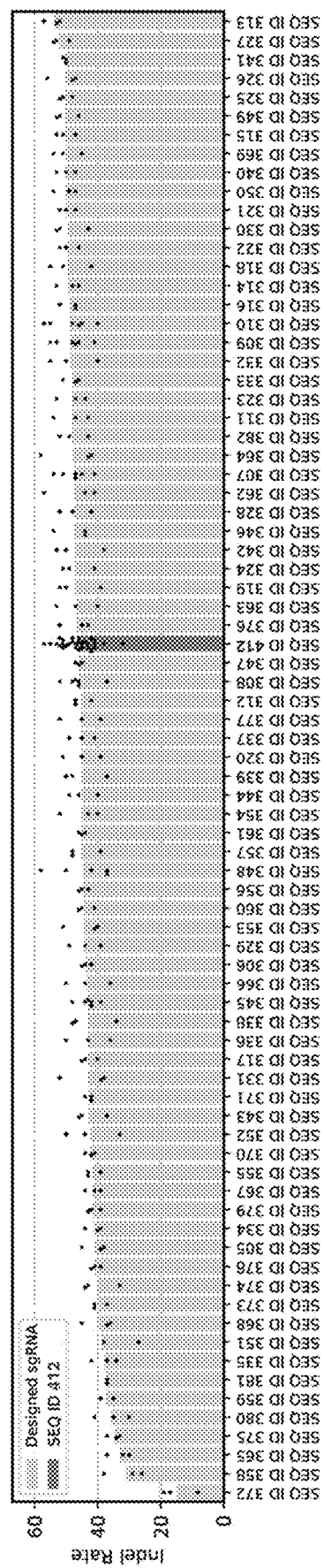
FIG. 5 is a graph of the editing efficiency based on indel rates for *Streptococcus pyogenes* Cas9 (spCas9) using the indicated synthetic gRNAs as compared to SEQ ID NO: 412 (dark grey) at the HEK3 target site.
Figure 6:
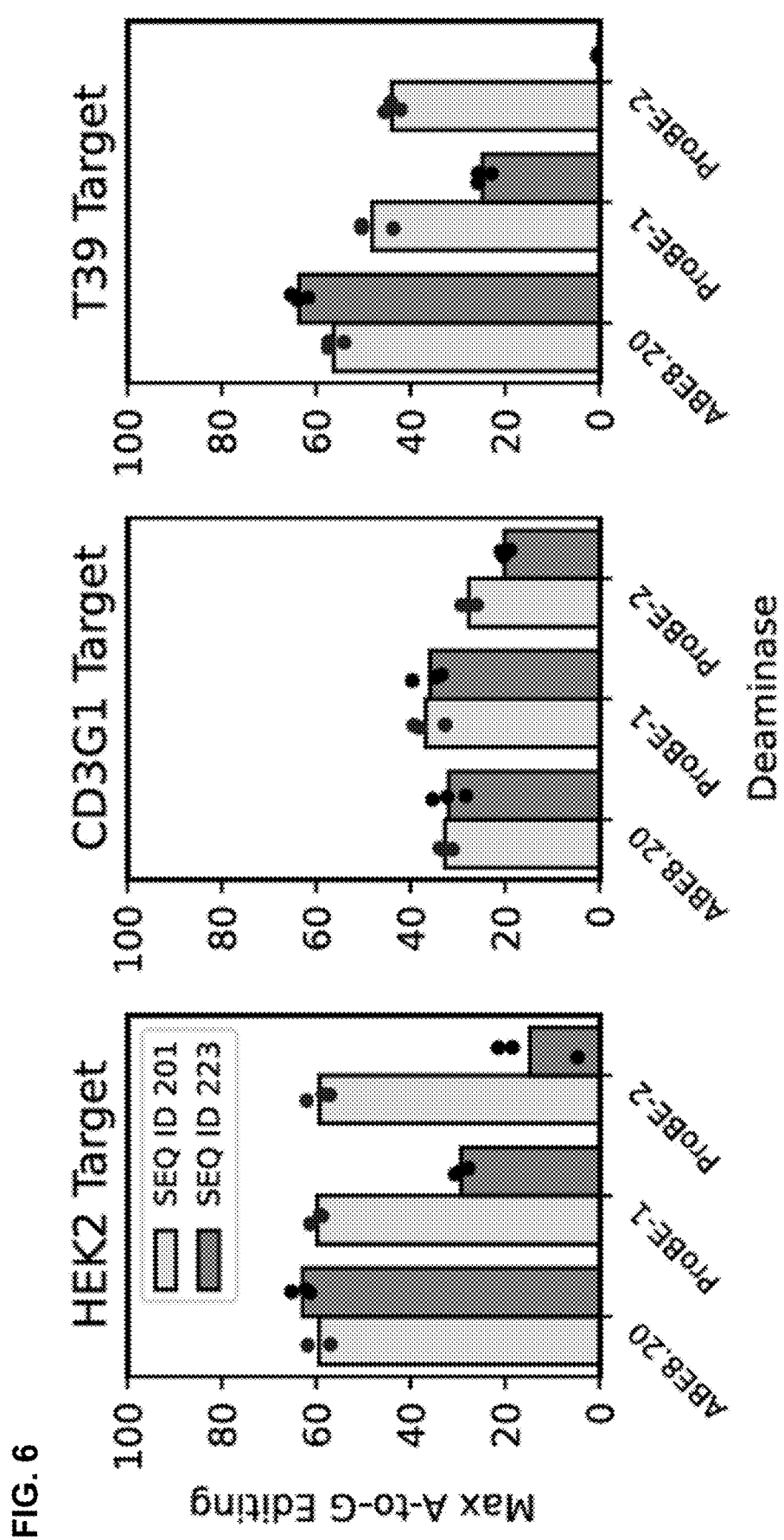
FIG. 6 is graphs of A to G editing with three base editors ABE8.20 (deaminase domain as in Gaudelli, N. M., et al. *Nat Biotechnol* 38, 892-900 (2020), ProBEI (deaminase domain sequence: SEQ ID NO: 411), and ProBE-2 (deaminase domain sequence: SEQ ID NO: 410) using nuclease domains of SEQ ID NO: 201 (light grey) and SEQ ID NO: 223 (dark grey) having D10A mutations.

The disclosed polypeptides, compositions, systems, kits, and methods include engineered nucleases useful for nucleic acid modification.

Section headings as used in this section and the entire disclosure herein are merely for organizational purposes and are not intended to be limiting.

Definitions

The terms "comprise(s)," "include(s)," "having," "has," "can," "contain(s)," and variants thereof, as used herein, are intended to be open-ended transitional phrases, terms, or words that do not preclude the possibility of additional acts or structures. As used herein, comprising a certain sequence or a certain SEQ ID NO usually implies that at least one copy of said sequence is present in recited peptide or polynucleotide. However, two or more copies are also contemplated. The singular forms "a," "and," and "the" include plural references unless the context clearly dictates otherwise. The present disclosure also contemplates other embodiments "comprising," "consisting of," and "consisting essentially of," the embodiments or elements presented herein, whether explicitly set forth or not.

For the recitation of numeric ranges herein, each intervening number there between with the same degree of precision is explicitly contemplated. For example, for the range of 6-9, the numbers 7 and 8 are contemplated in addition to 6 and 9, and for the range 6.0-7.0, the number 6.0, 6.1, 6.2, 6.3, 6.4, 6.5, 6.6, 6.7, 6.8, 6.9, and 7.0 are explicitly contemplated.

Unless otherwise defined herein, scientific, and technical terms used in connection with the present disclosure shall have the meanings that are commonly understood by those of ordinary skill in the art. For example, any nomenclature used in connection with, and techniques of cell and tissue culture, molecular biology, microbiology, genetics and protein and nucleic acid chemistry and hybridization described herein are those that are well known and commonly used in the art. The meaning and scope of the terms should be clear; in the event, however of any latent ambiguity, definitions provided herein take precedent over any dictionary or extrinsic definition. Further, unless otherwise required by context, singular terms shall include pluralities and plural terms shall include the singular.

As used herein, "nucleic acid" or "nucleic acid sequence" refers to a polymer or oligomer of pyrimidine and/or purine bases, preferably cytosine, thymine, and uracil, and adenine and guanine, respectively (See Albert L. Lehninger, *Principles of Biochemistry*, 793-800 (Worth Pub. 1982)). The present technology contemplates any deoxyribonucleotide, ribonucleotide, or nucleoprotein component, and any chemical variants thereof, such as methylated, hydroxymethylated, or glycosylated forms of these bases, and the like. The polymers or oligomers may be heterogenous or homogenous in composition and may be isolated from naturally occurring sources or may be artificially or synthetically produced. In addition, the nucleic acids may be DNA or RNA, or a mixture thereof, and may exist permanently or transitionally in single-stranded or double-stranded form, including homo-duplex, heteroduplex, and hybrid states. In some embodiments, a nucleic acid or nucleic acid sequence comprises other kinds of nucleic acid structures such as, for instance, a DNA/RNA helix, peptide nucleic acid (PNA), morpholino nucleic acid (see, e.g., Braasch and Corey, Biochemistry, 41 (14): 4503-4510 (2002) and U.S. Pat. No. 5,034,506), locked nucleic acid (LNA; see Wahlestedt et al., Proc. Natl. Acad. Sci. U.S.A., 97:5633-5638 (2000)), cyclohexenyl nucleic acids (see Wang, J. Am. Chem. Soc., 122:8595-8602 (2000)), and/or a ribozyme. Hence, the term "nucleic acid" or "nucleic acid sequence" may also encompass a chain comprising non-natural nucleotides, modified nucleotides, and/or non-nucleotide building blocks that can exhibit the same function as natural nucleotides (e.g., "nucleotide analogs"); further, the term "nucleic acid sequence" as used herein refers to an oligonucleotide, nucleotide or polynucleotide, and fragments or portions thereof, and to DNA or RNA of genomic or synthetic origin, which may be single or double-stranded, and represent the sense or antisense strand. The terms "nucleic acid," "polynucleotide," "nucleotide sequence," and "oligonucleotide" are used interchangeably. They refer to a polymeric form of nucleotides of any length, either deoxyribonucleotides or ribonucleotides, or analogs thereof.

As used herein, "peptide," "polypeptide," or "protein" refer to a sequence of two or more amino acids linked by peptide bonds. The polypeptide can be natural, synthetic, or a modification or combination of natural and synthetic. The peptide or polypeptide may be modified by the addition of sugars, lipids or other moieties not included in the amino acid chain. The terms "polypeptide," "oligopeptide," and "peptide" are used interchangeably herein. The peptide(s) may be produced by recombinant genetic technology or chemical synthesis. The peptide(s) may be isolated and purified by any number of standard methods including, but not limited to, differential solubility (e.g., precipitation), centrifugation, chromatography (e.g., affinity, ion exchange, and size exclusion), or by any other standard techniques known in the art.

The term "amino acid" or "any amino acid" as used here refers to any and all amino acids, including naturally occurring amino acids (e.g., a-amino acids), unnatural amino acids, modified amino acids, and non-natural amino acids. It includes both D- and L-amino acids. Natural amino acids include those found in nature, such as, e.g., the 23 amino acids that combine into peptide chains to form the building-blocks of a vast array of proteins. These are primarily L stereoisomers, although a few D-amino acids occur in bacterial envelopes and some antibiotics. For the most part, the names of naturally occurring and non-naturally occurring aminoacyl residues used herein follow the naming conventions suggested by the IUPAC Commission on the Nomenclature of Organic Chemistry and the IUPAC-IUB Commission on Biochemical Nomenclature as set out in "Nomenclature of α-Amino Acids (Recommendations, 1974)" Biochemistry, 14 (2), (1975). To the extent that the names and abbreviations of amino acids and aminoacyl residues employed in this specification and appended claims differ from those suggestions, they will be made clear to the reader. Throughout the present specification, unless naturally occurring amino acids are referred to by their full name (e.g., alanine, arginine, etc.), they are designated by their conventional three-letter or single-letter abbreviations (e.g., Ala or A for alanine, Arg or R for arginine, etc.). The term "L-amino acid," as used herein, refers to the "L" isomeric form of a peptide, and conversely the term "D-amino acid" refers to the "D" isomeric form of a peptide (e.g., Dphe, (D) Phe, D-Phe, or $^D$F for the D isomeric form of Phenylalanine). Amino acid residues in the D isomeric form can be substituted for any L-amino acid residue, as long as the desired function is retained by the peptide.

Nucleic acid or amino acid sequence "identity," as described herein, can be determined by comparing a nucleic acid or amino acid sequence of interest to a reference nucleic acid or amino acid sequence. A number of mathematical algorithms for obtaining the optimal alignment and calculating identity between two or more sequences are known and incorporated into a number of available software programs. Examples of such programs include CLUSTAL-W, T-Coffee, and ALIGN (for alignment of nucleic acid and amino acid sequences), BLAST programs (e.g., BLAST 2.1, BL2SEQ, and later versions thereof) and FASTA programs (e.g., FASTA3x, FAS™, and SSEARCHfor sequence alignment and sequence similarity searches). Sequence alignment algorithms also are disclosed in, for example, Altschul et al., *J. Molecular Biol.*, 215 (3): 403-410 (1990), Beigert et al., *Proc. Natl. Acad. Sci. USA*, 106 (10): 3770-3775 (2009), Durbin et al., eds., *Biological Sequence Analysis: Probabilistic Models of Proteins and Nucleic Acids*, Cambridge University Press, Cambridge, UK (2009), Soding, *Bioinformatics*, 21 (7): 951-60 (2005), Altschul et al., *Nucleic Acids Res.*, 25 (17): 3389-3402 (1997), and Gusfield, *Algorithms on Strings, Trees and Sequences*, Cambridge University Press, Cambridge UK (1997)).

The term "gene" refers to a nucleic acid sequence that comprises control and coding sequences necessary for the production of a gene product (e.g., an RNA having a non-coding function (e.g., a ribosomal or transfer RNA), a polypeptide, or a precursor of any of the foregoing). The RNA or polypeptide can be encoded by a full length coding sequence or by any portion of the coding sequence so long as the desired activity or function is retained. Thus, a "gene" refers to a DNA or RNA, or portion thereof, that encodes a polypeptide or an RNA chain that has functional role to play in an organism. For the purpose of this disclosure, it may be considered that genes include regions that regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites, and locus control regions.

A cell has been "genetically modified," "transformed," or "transfected" by exogenous DNA, e.g., a recombinant expression vector, when such DNA has been introduced inside the cell. The presence of the exogenous DNA results in permanent or transient genetic change. The transforming DNA may or may not be integrated (covalently linked) into the genome of the cell. For example, the transforming DNA may be maintained on an episomal element such as a plasmid. With respect to eukaryotic cells, a stably transformed cell is one in which the transforming DNA has become integrated into a chromosome so that it is inherited by daughter cells through chromosome replication. This stability is demonstrated by the ability of the eukaryotic cell to establish cell lines or clones that comprise a population of daughter cells containing the transforming DNA. A "clone" is a population of cells derived from a single cell or common ancestor by mitosis. A "cell line" is a clone of a primary cell that is capable of stable growth in vitro for many generations.

The terms "non-naturally occurring," "engineered," and "synthetic" are used interchangeably and indicate the involvement of the hand of man. The terms, when referring to nucleic acid molecules or polypeptides mean that the nucleic acid molecule or the polypeptide is at least substantially free from at least one other component with which it is naturally associated in nature and as found in nature, and/or the nucleic acid molecule or the polypeptide is associated with at least one other component with which it is not naturally associated in nature and/or that there is one or more changes in nucleic acid or amino acid sequence as compared with such sequence as it is found in nature and/or that the nucleic acid or polypeptide sequence was generated de novo, e.g., not based on or derived from any naturally occurring sequence.

A "vector" or "expression vector" is a replicon, such as plasmid, phage, virus, or cosmid, to which another DNA segment, e.g., an "insert," may be attached or incorporated so as to bring about the replication of the attached segment in a cell.

The term "contacting" as used herein refers to bring or put in contact, to be in or come into contact. The term "contact" as used herein refers to a state or condition of touching or of immediate or local proximity.

As used herein, the terms "providing," "administering," and "introducing" are used interchangeably herein and refer to the placement into a cell, organism, or subject by a method or route which results in at least partial localization to a desired site. Administration may be by any appropriate route which results in delivery to a desired location in the cell, organism, or subject.

A "subject" or "patient" may be human or non-human and may include, for example, animal strains or species used as "model systems" for research purposes, such a mouse model as described herein. Likewise, a patient may include either adults or juveniles (e.g., children). Moreover, patient may mean any living organism, preferably a mammal (e.g., human or non-human) that may benefit from the administration of compositions contemplated herein. Examples of mammals include, but are not limited to, any member of the Mammalian class: humans, non-human primates such as chimpanzees, and other apes and monkey species; farm animals such as cattle, horses, sheep, goats, swine; domestic animals such as rabbits, dogs, and cats; laboratory animals including rodents such as rats, mice, and guinea pigs, and the like. Examples of non-mammals include, but are not limited to, birds, fish, and the like. In one embodiment of the methods and compositions provided herein, the mammal is a human.

Preferred methods and materials are described below, although methods and materials similar or equivalent to those described herein can be used in practice or testing of the present disclosure. All publications, patent applications, patents and other references mentioned herein are incorporated by reference in their entirety. The materials, methods, and examples disclosed herein are illustrative only and not intended to be limiting.

Nucleases

Disclosed herein are engineered nucleases. In some embodiments, the engineered nucleases comprise an amino acid sequence having at least 75% identity (e.g., at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%) to any one of SEQ ID NOs: 1-304. In some embodiments, the engineered nucleases comprise an amino acid sequence of any one of SEQ ID NOs: 1-304.

In some embodiments, the engineered nucleases comprise an amino acid sequence having at least 75% identity to any one of SEQ ID NOs: 201, 202, 208, 212, 223, and 250. In some embodiments, the engineered nucleases comprise an amino acid sequence of any one of SEQ ID NOs: 201, 202, 208, 212, 223, and 250.

Any of the engineered nucleases described herein may comprise one or more (e.g., 1, 2, 3, 4, 5, 6, 7, 8, 9, 10, 15, 20, 25, or more, etc.) amino acid substitutions as compared to SEQ ID NOs: 1-200. An amino acid "replacement" or "substitution" refers to the replacement of one amino acid at a given position or residue by another amino acid at the same position or residue within a polypeptide sequence. Amino acids are broadly grouped as "aromatic" or "aliphatic". An aromatic amino acid includes an aromatic ring. Examples of aromatic amino acids include histidine (H or His), phenylalanine (F or Phe), tyrosine (Y or Tyr), and tryptophan (W or Trp). Non-aromatic amino acids are broadly grouped as aliphatic. Examples of aliphatic amino acids include glycine (G or Gly), alanine (A or Ala), valine (V or Val), leucine (L or Leu), isoleucine (I or Ile), methionine (M or Met), serine (S or Ser), threonine (T or Thr), cysteine (C or Cys), proline (P or Pro), glutamic acid (E or Glu), aspartic acid (A or Asp), asparagine (N or Asn), glutamine (Q or Gln), lysine (K or Lys), and arginine (R or Arg).

The amino acid replacement or substitution can be conservative, semi-conservative, or non-conservative. The phrase "conservative amino acid substitution" or "conservative mutation" refers to the replacement of one amino acid by another amino acid with a common property. A functional way to define common properties between individual amino acids is to analyze the normalized frequencies of amino acid changes between corresponding proteins of homologous organisms (Schulz and Schirmer, Principles of Protein Structure, Springer-Verlag, New York (1979)). According to such analyses, groups of amino acids may be defined where amino acids within a group exchange preferentially with each other and therefore resemble each other most in their impact on the overall protein structure (Schulz and Schirmer). Examples of conservative amino acid substitutions include substitutions of amino acids within the sub-groups described above, for example, lysine for arginine and vice versa such that a positive charge may be maintained, glutamic acid for aspartic acid and vice versa such that a negative charge may be maintained, serine for threonine such that a free —OH can be maintained, and glutamine for asparagine such that a free —NH$_2$ can be maintained. "Semi-conservative mutations" include amino acid substitutions of amino acids within the same groups listed above, but not within the same sub-group. For example, the substitution of aspartic acid for asparagine, or asparagine for lysine, involves amino acids within the same group, but different sub-groups. "Non-conservative mutations" involve amino acid substitutions between different groups, for example, lysine for tryptophan, or phenylalanine for serine, etc.

In some embodiments, the engineered nucleases comprise one or more amino acid substitutions configured to fully or partially catalytically inactivate the nuclease. For example, the engineered nucleases may comprise one or more amino acids substitutions in one or more of the catalytic domains (e.g., a RuvC domain, an HNH domain), resulting in full or partial inhibition of nuclease functionality. Full inhibition renders the engineered nuclease completely absent of any nuclease functionality. Partial inhibition can be a result of catalytic inactivation of one of the catalytic domains of the engineered nuclease. Such partial inhibition can remove the ability to cleave two strands of a target nucleic acid, resulting in an enzyme referred to as a nickase only capable of cleaving a single strange of a double-stranded target nucleic acid. For example, in some embodiments, the engineered nucleases have a D10A mutation.

In some embodiments, the engineered nucleases comprise an amino acid sequence having less than about 80% (e.g., less than about 75%, less than about 70%, less than about 65%, etc.) identity to the sequence of *Streptococcus pyogenes* Cas9 (SpCas9).

In some embodiments, the engineered nuclease further comprises a localization or signal sequence (e.g., nuclear localization sequence), a sequence tag (e.g., a tag for detection, purification, and/or monitoring expression), a protein transduction domain sequence, or a combination thereof.

In some embodiments, the engineered nuclease comprises one or more nuclear localization sequences (NLSs). The nuclear localization sequence may be appended, for example, to the N-terminus, a C-terminus, internally, or a combination thereof. In such cases when the engineered nuclease comprises two or more NLSs, the NLSs may be in tandem, separated by a linker, at either end of the protein, or one or more may be embedded in the protein.

The nuclear localization sequence may comprise any amino acid sequence known in the art to functionally tag or direct a protein for import into a cell's nucleus (e.g., for nuclear transport). Usually, a nuclear localization sequence comprises one or more positively charged amino acids, such as lysine and arginine. The NLS may be appended by a linker.

In some embodiments, the NLS is a monopartite sequence. A monopartite NLS comprises a single cluster of positively charged or basic amino acids. In some embodiments, the monopartite NLS comprises a sequence of K-K/R-X-K/R, wherein X can be any amino acid. Exemplary monopartite NLS sequences include those from the SV40 large T-antigen, c-Myc, and TUS-proteins. In some embodiments, the NLS is a bipartite sequence. Bipartite NLSs comprise two clusters of basic amino acids, separated by a spacer of about 9-12 amino acids. Exemplary bipartite NLSs include the nuclear localization sequences of nucleoplasmin, EGL-12, or bipartite SV40. In some embodiments, the NLS comprises a sequence of: KR (K/R) R (SEQ ID NOs: 383-384); K (K/R) RK (SEQ ID NOs: 385-386); (R/P)

XXKR (K/R) (^DE) (SEQ ID NOS: 387-390) or (R/P) XXKR (^DE) (K/R) (SEQ ID NOs: 391-394) wherein (^DE) represents any amino acid except for Asp or Glu; KRX (W/F/Y) XXAF (SEQ ID NOs: 395-397); LGKR (K/R) (W/F/Y) (SEQ ID NO: 398-399); or a bipartite sequence thereof.

The engineered nuclease may also comprise a tag (e.g., 3×FLAG tag, an HA tag, a Myc tag, a poly-histidine tag, a SNAP-tag, a CLIP-tag, and the like). The tags may be at the N-terminus, a C-terminus, or a combination thereof of the engineered nuclease. In some embodiments, the tag may be adjacent, either upstream or downstream, to a nuclear localization sequence.

In some embodiments, the engineered nuclease may be fused with one or more (e.g., two, three, four, or more) protein transduction moieties. A protein transduction moiety is a polypeptide, polynucleotide, carbohydrate, or organic or inorganic compound that facilitates traversing a lipid bilayer, micelle, cell membrane, organelle membrane, or vesicle membrane. A protein transduction moiety attached to another molecule facilitates the molecule traversing a membrane, for example going from extracellular space to intracellular space, or cytosol to within an organelle.

Accordingly in some embodiments, the engineered nuclease comprises one or more polypeptide transduction moieties. The polypeptide transduction moiety may be at a terminus of the engineered nuclease (e.g., N-terminus or C-terminus), or alternatively be inserted internally. Examples of polypeptide transduction moieties include but are not limited to a minimal undecapeptide polypeptide transduction domain (corresponding to residues 47-57 of HIV-1 TAT comprising); a polyarginine sequence comprising a number of arginines sufficient to direct entry into a cell (e.g., 3, 4, 5, 6, 7, 8, 9, 10, or 10-50 arginines); a VP22 domain (Zender et al. (2002) Cancer Gene Ther. 9 (6): 489-96); a *Drosophila* Antennapedia protein transduction domain (Noguchi et al. (2003) Diabetes 52 (7): 1732-1737); a truncated human calcitonin peptide (Trehin et al. (2004) Pharm. Rescarch 21:1248-1256); polylysine (Wender et al. (2000) Proc. Natl. Acad. Sci. USA 97:13003-13008); transportan, and the like.

Fusion Proteins

The present disclosure also provides fusion proteins comprising the engineered nucleases described herein and one or more effector or functional domains. The fusion proteins are not limited by orientation or directionality of the engineered nuclease and the one or more effector domains. For example, any single effector domain may be fused to the N-terminus or C-terminus of the engineered nuclease, in any orientation, e.g., N-terminus to N-terminus, C-terminus to C-terminus, N-terminus to C-terminus, or C-terminus to N-terminus, and directly or indirectly (e.g., fused to another effector domain fused to the N-terminus).

Effector or functional domains are proteins or fragments thereof that can modify, regulate, or act as a tag for a target nucleic acid. For example, an effector domain can be used to target enzymatic activities to a nucleic acid sequence which the engineered nuclease targets (e.g., by way of a guide RNA, described elsewhere herein). In some embodiments, an effector domain is a fragment of protein that has been separated from its natural DNA binding domain and engineered to be part of a fusion protein with an engineered nuclease described herein. In some embodiments, an effector domain is a protein which normally binds to other proteins or factors for recruitment to a specific or non-specific nucleic acid.

An effector or functional domain may comprise a number of functionalities, including but not limited to, recombinase function, epigenetic modifying function (e.g., histone acetylase function, histone deacetylase function), integrase function, resolvase function, invertase function, protease function, nuclease function, DNA methyltransferase function, DNA demethylase function, transcriptional repressor function, transcriptional activator function, DNA binding protein function, transcription factor recruiting protein function, nuclear-localization signal function, DNA editing function (e.g., deaminase), degradation signaling, or any combination thereof. In some embodiments, the one or more effector or functional domains include a transcription activator, a transcription repressor, a deaminase, a polymerase (e.g., reverse transcriptase), an epigenetic modifier, a detection agent (e.g., fluorescent protein or protein tag), or a combination thereof.

In some embodiments, the fusion protein is used to modulate gene regulatory activity, such as transcriptional or translational activity. For example, the one or more effector domain comprises a transcription activator and/or repressor activity that can affect transcription upstream and downstream of coding regions, and can be used to activate or repress gene expression. In some embodiments, the one or more effector domain includes domains from transcription factors (activators, repressors, coactivators, co-repressors), silencers, and/or chromatin associated proteins and their modifiers (e.g., methylases, demethylases, acetylases and deacetylases).

In some embodiments, the one or more effector domain comprises transcriptional repressor function. Transcription repressors prevent, partially or completely, the transcription of genes near to the target site. Exemplary transcriptional repressors include, but are not limited to, KRAB-domain containing proteins, SID, and Sp1.

In some embodiments, the one or more effector domain comprises transcriptional activator function. Transcriptional activators can be generally defined as proteins, or domains thereof, that bind to specific sites on promoter DNA and bring about increased transcription of specific genes through interactions with other proteins. Exemplary transcriptional activators include, but are not limited to, VP64, p65, p53, c-Myb, GATA-1, EKLF, MyoD, E2F, dTCF, Tat, HSF1, RTA and SET7/9.

In some embodiments, a fusion protein as disclosed herein can comprise an effector domain comprising a transcriptional effector recruiting domain, or active fragment thereof. The transcriptional effector recruiting domain can recruit transcriptional activators or repressors, e.g., to the specific nucleic acid sequence which the engineered nuclease is bound to localize activators and repressors to modulate gene expression in a targeted manner.

In some embodiments, the one or more effector domain comprises DNA methyltransferase or DNA methylase function. DNA methyltransferases (DNMT's) are a family of DNA modifying proteins composed of different isomers (e.g., DNMT1, DNMT3A, and DNMT3B). Other exemplary DNA methyltransferases include SssI methylase, AluI methylase, HaeIII methylase, HhaI methylase, and HpaII methylase. Their main mechanism of action is addition of a methyl group to the fifth carbon of a cytosine residue (5mc) located adjacent to a guanine residue. DNA demethylation can be mediated by at least three enzyme families: (i) the ten-eleven translocation (TET) family, mediating the conversion of 5mC into 5hmC; (ii) the AID/APOBEC family, acting as mediators of 5mC or 5hmC deamination; and (iii) the BER (base excision repair) glycosylase family involved in DNA repair.

In some embodiments, the one or more effector domain modifies epigenetic signals and thereby modify gene regulation, for example by promoting histone acetylase and histone deacetylase activity. The term "epigenetic modifier," as used herein, refers to a protein or catalytic domain thereof having enzymatic activity that results in the epigenetic modification of DNA, for example, chromosomal DNA. Epigenetic modifications include, but are not limited to, histone modifications including methylation and demethylation (e.g., mono-, di- and tri-methylation), histone acetylation and deacetylation, as well as histone ubiquitylation, phosphorylation, and sumoylation.

Histone acetylation and deacetylation are the processes by which the lysine residues within the N-terminal tail protruding from the histone core of the nucleosome are acetylated and deacetylated as part of gene regulation. These reactions are typically catalyzed by enzymes with histone acetyltransferase (HAT) or histone deacetylase (HDAC) activity. Histone acetyltransferases include GNAT family proteins (e.g., Gcn5, Gcn5L, p300/CREB-binding protein associated factor (PCAF), Elp3, HPA2 and HAT1) and MYST family proteins (e.g., Sas3, essential SAS-related acetyltransferase (Esa1), Sas2, Tip60, MOF, MOZ, MORF, and HBO1). Histone deacetylases fall into four classes. Class I includes HDACs 1, 2, 3, and 8. Class II is divided into two subgroups, Class IIA and Class IIB. Class IIA includes HDACs 4, 5, 7, and 9 while Class IIB includes HDACs 6 and 10. Class III contains the Sirtuins and Class IV contains only HDAC11. Classes of HDAC proteins are divided and grouped together based on the comparison to the sequence homologies of Rpd3, Hos1 and Hos2 for Class I HDACs, HDA1 and Hos3 for the Class II HDACs and the sirtuins for Class III HDACs.

The site-specific methylation and demethylation of histone residues are catalyzed by methyltransferases and demethylases, respectively. Histone methylases transfer methyl groups to amino acids (e.g., lysine and arginine) of histone proteins, ultimately effecting transcription of genes. Methylases include SET1, MLL, SMYD3, G9a, GLP, EZH2, and SETDB1. Histone demethylases catalyze the removal of methyl marks from histones, an activity associated with transcriptional regulation and DNA damage repair. Demethylases include, for example, KDM1A, KDM1B, KDM2A, KDM2B, UTX, UTY, Jumonji C (JmJC) domain-containing demethylases, and GSK-J4.

In some embodiments, the one or more effector domain comprises recombinase activity. A recombinase is a site-specific enzyme that mediates the recombination of DNA between recombinase recognition sequences, which results in the excision, integration, inversion, or exchange (e.g., translocation) of DNA fragments between the recombinase recognition sequences. Recombinases can be classified into two distinct families: serine recombinases (e.g., resolvases and invertases) and tyrosine recombinases (e.g., integrases). Examples of serine recombinases include, without limitation, Hin, Gin, Tn3 (also known as TnpR), β-six, CinH, ParA, γδ, Bxb1, φC31, TP901, TG1, φBT1, R4, φRV1, φFC1, MR11, A118, U153, and gp29. Examples of tyrosine recombinases include, without limitation, Cre, FLP, R, Lambda, HK101, HK022, and pSAM2.

In some embodiments, the one or more effector domain comprises DNA editing function (e.g., deaminase, DNA repair activity, DNA damage activity, dismutase activity, alkylation activity, depurination activity, oxidation activity, pyrimidine dimer forming activity, polymerase activity (e.g., reverse transcriptase), ligase activity, helicase activity, photolyase activity or glycosylase activity). In some embodiments, the one or more effector domain comprises a reverse transcriptase. In some embodiments, the one or more effector domain comprises a deaminase, e.g., a cytosine deaminase or an adenine deaminase.

Kinases, phosphatases, and other proteins that modify or regulate other polypeptides involved in gene regulation are also useful as effector domains. Such modifiers are often involved in switching on or off transcription mediated by, for example, hormones. Other useful domains for regulating gene expression can also be obtained from the gene products of oncogenes (e.g., myc, jun, fos, myb, max, mad, rel, ets, bcl, myb, mos family members) and their associated factors and modifiers.

In some embodiments, the one or more effector domain comprises an integrase. Integrases allow for the insertion of nucleic acids, for example, into a host genome (mammalian, human, mouse, rat, monkey, frog, fish, plant (including crop plants and experimental plants like *Arabidopsis*), laboratory or biomedical cell lines or primary cell cultures, *C. elegans*, fly (*Drosophila*), etc.). Integrases are found in a retrovirus such as HIV (human immunodeficiency virus) and lambda integrase.

In some embodiments, the one or more effector domain comprises transposase functionality. Transposases are enzymes that bind to the end of a transposon and catalyze its movement by a cut and paste mechanism or a replicative transposition mechanism. Exemplary transposases include, but are not limited to, Tc1 transposase, Mos1 transposase, Tn5 transposase, and Mu transposase.

In some embodiments, the one or more effector domain comprises invertase activity. Invertase activity can be used to alter genome structure by swapping the orientation of a DNA fragment.

In some embodiments, the one or more effector domain comprises resolvase activity. Resolvases are site-specific recombinases that function to excise (as a circle) a segment of DNA contained between two recombination sites (called res) and include, for example, Ruv C resolvase, Holiday junction resolvase Hjc, Tn3 and γδ resolvase.

In some embodiments, the one or more effector domain comprises a peptide or polypeptide sequence responsive to a ligand, such as a hormone receptor ligand binding domain, including, for example, the ligand binding domains of the estrogen receptor, the glucocorticosteroid receptor, and the like. Such effector domains can be used to act as "gene switches," and be regulated by inducers, such as small molecule or protein ligands, specific for the ligand binding domain.

In some embodiments, the one or more effector domain comprises sequences or domains of polypeptides that mediate direct or indirect protein-protein interactions, including, for example, a leucine zipper domain, a STAT protein N terminal domain, and/or an FK506 binding protein.

In some embodiments, the activity mediated by the one or more effector domain is a non-biological activity, such as a fluorescence activity (e.g., fluorescent proteins), luminescence activity (e.g., a luminescent protein or enzyme which results in luminescence when interacting with a substrate (e.g., luciferase)), or binding activity, such as those mediated by maltose binding protein ("MBP"), glutathione S transferase (GST), hexahistidine, c-myc, and the FLAG epitope, for facilitating detection, purification, monitoring expression, and/or monitoring cellular and subcellular localization of the engineered nuclease to which the effector domain is appended. In such embodiments, the fusion proteins can also be used as a diagnostic reagent, for example, to detect mutations in gene sequences, to purify restriction fragments from a solution, or to visualize nucleic acids.

In some embodiments, the effector domain facilitates temporal modulation of the fusion protein, and accordingly the engineered nuclease. Thus, in some embodiments, the effector domain is a degron. Degrons may be ubiquitin-independent degrons, not necessary for the polyubiquitination of their protein. Alternatively, ubiquitin-dependent degrons are implicated in the polyubiquitination process for targeting a protein to the proteasome. For example, the effector domain may comprise a truncated geminin protein. Geminin is a direct substrate of E3 ubiquitin ligase complex APC/Cdh1 and is actively ubiquitinated in the M/G1 phase. Thus, degradation of the fusion protein will be promoted during the M/G1 phase thereby restricting activity of the fusion protein to largely the G2/S phase.

The effector domains described herein are illustrative and merely provide the skilled artisan with examples of effectors that can be used in combination with the engineered nucleases, systems and methods described herein.

In some embodiments, the one or more effector or functional domain and the engineered nuclease are covalently linked in a single amino acid chain through a linker. The linker may have any of a variety of amino acid sequences. Proteins can be joined by a linker polypeptide, generally of a flexible nature, although other chemical linkages are not excluded. Suitable linkers include polypeptides of between 1 amino acids and 100 amino acids in length, 4 amino acids and 40 amino acids in length, or between 4 amino acids and 25 amino acids in length. The linking peptides may have virtually any amino acid sequence, bearing in mind that the preferred linkers will have a sequence that results in a generally flexible peptide. Small amino acids, such as glycine and alanine, are useful in creating a flexible peptide linker. A variety of different linkers are considered suitable for use, including but not limited to, glycine-serine polymers, glycine-alanine polymers, and alanine-serine polymers. Such fusion proteins can be expressed recombinantly from a single nucleic acid encoding the amino acid chain.

Alternatively, the one or more effector domain and the engineered nuclease may be individually fused to one half of a binding pair (e.g., from a recruitment system) and, when introduced into the same system or location, the one or more effector domain and the engineered nuclease form a protein conjugate through the recruitment system. The recruitment system can comprise any binding pair. For example, the recruitment system may comprise an aptamer and an aptamer binding protein. The recruitment system may be a so-called split system. Split systems include two or more polypeptide chains that reassemble into an operable fusion protein or protein conjugate upon association of the two binding partners. Split systems include, but are not limited to, intein, MS2, or SunTag based systems.

In some embodiments, the aptamer sequence is a nucleic acid (e.g., RNA aptamer) sequence. In some embodiments, the guide RNA also comprises a sequence of one or more RNA aptamers, or distinct RNA secondary structures or sequences that can recruit and bind another molecular species, an adaptor molecule, such as a nucleic acid or protein. Any RNA aptamer/aptamer binding protein pair known may be selected and used in connection with the present disclosure (see, e.g., Jayasena, S. D., Clinical Chemistry. 45 (9): p. 1628-1650, (1999); Gelinas, et al., Current Opinion in Structural Biology 36: p. 122-132, (2016); and Hasegawa, H., Molecules, 21 (4): p. 421 (2016), incorporated herein by reference).

In some embodiments, the aptamer sequence is a peptide aptamer sequence. In some embodiments, the engineered nuclease comprises the peptide aptamer sequence and the effector domain comprises the peptide aptamer binding protein. In some embodiments, the effector domain comprises the peptide aptamer sequence and the engineered nuclease comprises the peptide aptamer binding protein. The peptide aptamer sequence or peptide aptamer binding protein may be fused in any orientation (e.g., N-terminus to C-terminus, C-terminus to N-terminus, N-terminus to N-terminus). The peptide aptamer sequence or peptide aptamer binding protein may be fused by a linker region. Suitable linker regions are known in the art. The linker may be flexible or configured to allow the functionality and association with the DNA or other proteins with decreased steric hindrance. The linker sequences may provide an unstructured or linear region of the polypeptide, for example, with the inclusion of one or more glycine and/or serine residues. The linker sequences can be at least about 2, 3, 4, 5, 6, 7, 8, 9, 10 or more amino acids in length.

The peptide aptamers can be naturally occurring or synthetic peptides that are specifically recognized by an affinity agent. Such aptamers include, but are not limited to, a c-Myc affinity tag, an HA affinity tag, a His affinity tag, an S affinity tag, a methionine-His affinity tag, an RGD-His affinity tag, a 7xHis tag, a FLAG octapeptide, a strep tag or strep tag II, a V5 tag, or a VSV-G epitope. Corresponding aptamer binding proteins are well-known in the art and include, for example, primary antibodies, biotin, affimers, single domain antibodies, and antibody mimetics.

Any of the effector domains and engineered nucleases disclosed herein may further comprise one or more proteins, polypeptides (e.g., protein domain sequences), or peptides. For example, the engineered nucleases and/or fusion proteins disclosed herein may be fused to another protein or protein domain that provides for tagging or visualization. The one or more proteins, polypeptides (e.g., protein domain sequences), or peptides may be appended at an N-terminus, a C-terminus, internally, or a combination thereof. The one or more proteins, polypeptides (e.g., protein domain sequences), or peptides may be fused in any orientation in relationship to the disclosed protein. The one or more proteins, polypeptides (e.g., protein domain sequences), or peptides may be fused via a linker, as described above.

Systems and Compositions

Disclosed herein are systems and compositions that comprise an engineered nuclease or fusion protein as described herein, or one or more nucleic acids encoding the engineered nuclease or fusion protein. In some embodiments, the engineered nuclease and the one or more effector domains are provided in the system as separate polypeptides or nucleic acid(s) encoding thereof, in which each is linked to a half of a binding pair. Descriptions of the engineered nucleases, effector domains, and fusion proteins provided above are equally applicable to the systems and compositions.

In some embodiments, the compositions or systems further comprise at least one guide RNA (gRNA) or one or more nucleic acids comprising a sequence encoding the least one gRNA. In instances when the composition or system comprises more than one gRNA, each may be encoded on the same or different nucleic acid as the other gRNA, together or separate from the engineered nuclease, fusion protein, or effector domain. For example, the system and compositions may comprise a first nucleic acid encoding the engineered nuclease, fusion protein, or effector domain and a second nucleic acid encoding the gRNA. In one alternative, the system and compositions may comprise a single nucleic acid encoding the engineered nuclease, fusion protein, or effector domain and one or more of the at one gRNA.

In some embodiments, the at least one gRNA is provided in a ribonucleoprotein (RNP) complex with the engineered nuclease or fusion protein.

The gRNA may contain separate crRNA and tracrRNA sequences (a dual guide RNA), have the crRNA and tracrRNA fused by a flexible linker, or be a single guide RNA, sgRNA. The terms "gRNA," "guide RNA," and "gRNA" may be used interchangeably throughout to represent any of the form of gRNA.

The "guide sequence" refers to the sequence that hybridizes to (complementary to, partially or completely) a target nucleic acid sequence (e.g., the genome in a host cell) and therefore determines the sequence specificity of the gRNA. The portion of the gRNA that hybridizes to the target nucleic acid (a target site) is generally between 10-40 nucleotides in length, but can be longer based on the specific target. gRNAs or sgRNA(s) used in the present disclosure can be between about 5 and 100 nucleotides long, or longer. The gRNA may be a non-naturally occurring or engineered gRNA.

In some embodiments, the guide sequence and scaffold sequence are separate. In such embodiments, the guide sequence is appended to an additional sequence that is complementary to a portion of the scaffold sequence and functions to hybridize with a portion of the scaffold sequence.

In some embodiments, the guide sequence is fused to a scaffold sequence (e.g., a tracrRNA). Such a chimeric gRNA is referred to as a single guide RNA (sgRNA). Exemplary scaffold sequences will be evident to one of skill in the art and can be found, for example, in Jinek, et al. Science (2012) 337 (6096): 816-821, and Ran, et al. Nature Protocols (2013) 8:2281-2308, incorporated herein by reference in their entireties.

The gRNA may comprise a scaffold sequence of SEQ ID NO: 412, represented as DNA. In gRNA sequence all thymidines are uridines. In some embodiments, the gRNA may comprise a sequence having one or more nucleotide substitutions, insertions, or deletions as compared to SEQ ID NO: 412. In some embodiments, the gRNA comprises one or more nucleotide substitutions at positions A12, T17, A37, T44, A45, T46, and G69 in reference to SEQ ID NO: 412. In select embodiments, the gRNA comprises one or more of the following substitutions: A12G, T17C, A37T, T44A, A45C/T, T46A/C, and G69T in reference to SEQ ID NO: 412. In some embodiments, the gRNA comprises an insertion following position 36 and/or an insertion following position 61, in reference to SEQ ID NO: 412. In select embodiments, the gRNA comprises an insertion of a thymidine following position 36 and/or an insertion of adenosine, guanidine, or cytidine following position 61. In some embodiments, the gRNA comprises one or more nucleotide substitutions at positions A12, T17, A37, T44, A45, T46, and G69 and an insertion following position 36 and/or an insertion following position 61, in reference to SEQ ID NO: 412. In some embodiments, the gRNA comprises a sequence as in any of SEQ ID NO: 305-382.

The target sequence may or may not be flanked by a protospacer adjacent motif (PAM) sequence. In some embodiments, the target nucleic acid is flanked by a protospacer adjacent motif (PAM). A PAM site is a nucleotide sequence in proximity to a target sequence. For example, PAM may be a DNA sequence immediately following the DNA sequence targeted by the CRISPR-Cas system. PAM sequences are well-known in the art. Non-limiting examples of the PAM sequences include: CC, CA, AG, GT, TA, AC, CA, GC, CG, GG, CT, TG, GA, AGG, TGG, T-rich PAMs (such as TTT, TTG, TTC, etc.), NGG, NGA, NAG, and NGGNG, where "N" is any nucleotide.

In certain embodiments, the disclosed nucleases cleave a target sequence if an appropriate PAM is present. A PAM can be 5' or 3' of a target sequence. A PAM can be upstream or downstream of a target sequence. In one embodiment, the target sequence is immediately flanked on the 3' end by a PAM sequence. A PAM can be 1, 2, 3, 4, 5, 6, 7, 8, 9, 10 or more nucleotides in length. In certain embodiments, a PAM is between 2-6 nucleotides in length. The target sequence may or may not be located adjacent to a PAM sequence (e.g., PAM sequence located immediately 3' of the target sequence).

"Complementarity" refers to the ability of a nucleic acid to form hydrogen bond(s) with another nucleic acid sequence by either traditional Watson-Crick or other non-traditional types. A percent complementarity indicates the percentage of residues in a nucleic acid molecule, which can form hydrogen bonds (e.g., Watson-Crick base pairing) with a second nucleic acid sequence. Full complementarity is not necessarily required, provided there is sufficient complementarity to cause hybridization. There may be mismatches distal from the PAM.

To facilitate gRNA design, many computational tools have been developed (See Prykhozhij et al. (PLOS ONE, 10 (3): (2015)); Zhu et al. (PLOS ONE, 9 (9) (2014)); Xiao et al. (Bioinformatics. January 21 (2014)); Heigwer et al. (Nat Methods, 11 (2): 122-123 (2014)). Methods and tools for guide RNA design are discussed by Zhu (Frontiers in Biology, 10 (4) pp. 289-296 (2015)), which is incorporated by reference herein. Additionally, there are many publicly available software tools that can be used to facilitate the design of sgRNA(s); including but not limited to, Genscript Interactive CRISPR gRNA Design Tool, WU-CRISPR, and Broad Institute GPP sgRNA Designer. There are also publicly available pre-designed gRNA sequences to target many genes and locations within the genomes of many species (human, mouse, rat, zebrafish, C. elegans), including but not limited to, IDT DNA Predesigned Alt-R CRISPR-Cas9 guide RNAs, Addgene Validated gRNA Target Sequences, and GenScript Genome-wide gRNA databases.

In some embodiments, the compositions and systems may further comprise one or more additional genome engineering tools. For example, the compositions may further comprise nucleases, such as zinc finger nucleases (ZFNs) and/or transcription activator like effector nucleases (TALENs); transcriptional activators, transcriptional repressors, histone-modifying proteins, integrases, recombinases, and the like.

The compositions or systems may further comprise an excipient or carrier. Excipients and carriers may include any and all solvents, dispersion media, coatings, antibacterial and antifungal agents, isotonic and absorption delaying agents. Some examples of materials which can serve as excipients and/or carriers are sugars including, but not limited to, lactose, glucose and sucrose; starches including, but not limited to, corn starch and potato starch; cellulose and its derivatives including, but not limited to, sodium carboxymethyl cellulose, ethyl cellulose and cellulose acetate; powdered tragacanth; malt; gelatin; talc; excipients including, but not limited to, cocoa butter and suppository waxes; oils including, but not limited to, peanut oil, cottonseed oil, safflower oil, sesame oil, olive oil, corn oil and soybean oil; glycols; including propylene glycol; esters including, but not limited to, ethyl oleate and ethyl laurate; agar; buffering agents including, but not limited to, magnesium hydroxide and aluminum hydroxide; alginic acid;

pyrogen-free water; isotonic saline; Ringer's solution; ethyl alcohol, and phosphate buffer solutions, as well as other non-toxic compatible lubricants including, but not limited to, sodium lauryl sulfate and magnesium stearate, as well as coloring agents, releasing agents, coating agents, sweetening, flavoring and perfuming agents, preservatives and antioxidants. The compositions of the present invention and methods for their preparation will be readily apparent to those skilled in the art. Techniques and formulations may be found, for example, in Remington's Pharmaceutical Sciences, 19th Edition (Mack Publishing Company, 1995).

In some embodiments, the excipient or carrier is pharmaceutically acceptable. Pharmaceutically acceptable carriers, including buffers, are well known in the art, and may comprise phosphate, citrate, and other organic acids; antioxidants including ascorbic acid and methionine; preservatives; low molecular weight polypeptides; proteins, such as serum albumin, gelatin, or immunoglobulins; amino acids; hydrophobic polymers; monosaccharides; disaccharides; and other carbohydrates; metal complexes; and/or non-ionic surfactants. See, e.g., Remington: The Science and Practice of Pharmacy 20th Ed. (2000) Lippincott Williams and Wilkins, Ed. K. E. Hoover.

The carrier may include a delivery vehicle. Delivery vehicles such as nanoparticle- and lipid-based delivery systems can be used. Exemplary delivery vehicles include, but are not limited to, microparticle compositions comprising a variety of polymers, liposomes or lipid nanoparticles, viral vectors, ribonucleoprotein (RNP) complexes, and the like.

Microparticles can include, but are not limited to, liposomes, nanoparticles, microspheres, nanospheres, microcapsules, and nanocapsules. In some cases, microparticle can include one or more of the following: a poly(lactide-co-glycolide), aliphatic polyesters including, but not limited to, poly-glycolic acid and poly-lactic acid, hyaluronic acid, modified polysaccharides, chitosan, cellulose, dextran, polyurethanes, polyacrylic acids, pseudo-poly(amino acids), polyhydroxybutyrate-related copolymers, polyanhydrides, polymethylmethacrylate, poly(ethylene oxide), lecithin, lipids, and phospholipids, in any combination thereof.

In some embodiments, a liposome or lipid nanoparticle encapsulates the disclosed systems, nucleic acids, or proteins (e.g., engineered nucleases or fusion proteins thereof). Methods of making lipid compositions include, for example, lipid film hydration, optionally coupled with sonication or extrusion, solvent evaporation (e.g., ethanol injection, ether injection, or reverse phase evaporation), solvent-diffusion method, hot homogenization process, detergent removal methods, or combinations thereof. Any naturally occurring or synthetic vesicle forming lipid or combinations thereof can be used, including for example, di-aliphatic chain lipids, such as phospholipids; diglycerides; di-aliphatic glycolipids; single lipids such as sphingomyelin or glycosphingolipid; steroidal lipids; hydrophilic polymer derivatized lipids; or mixtures thereof. Liposome and lipid nanoparticle compositions of the disclosure may include one or more cationic and/or ionizable lipids, phospholipids, neutral or non-cationic lipids, polyethyleneglycol (PEG)-lipid conjugates, and/or sterols. In some embodiments, the lipid nanoparticle comprises a cationic lipid and/or ionizable lipid, a neutral or non-cationic lipid, and cholesterol.

The liposomes and lipid nanoparticles described herein may also include other components typically used in the formation of vesicles (e.g., for stabilization). Examples of such other components includes, without being limited thereto, fatty alcohols, fatty acids, and/or any other pharmaceutically acceptable excipients which may affect the surface charge, the membrane fluidity and assist in the incorporation of the lipid into the lipid assembly.

The liposome and lipid nanoparticle compositions of the disclosure can also be targeting compositions, e.g., contain one or more targeting moieties or biodistribution modifiers on the surface. A targeting moiety can be any agent that is capable of specifically binding or interacting with a desired target and are generally known in the art, for example ligands such as folic acid, proteins, antibody or antibody fragments, and the like).

The phrase "pharmaceutically acceptable," as used in connection with the present disclosure, refers to molecular entities and other ingredients of such compositions that are physiologically tolerable and do not typically produce untoward reactions when administered to a subject (e.g., a mammal, a human). Preferably, as used herein, the term "pharmaceutically acceptable" means approved by a regulatory agency of the federal or a state government or listed in the U.S. Pharmacopeia or other generally recognized pharmacopeia for use in mammals, and more particularly in humans. "Acceptable" means that the carrier is compatible with the composition (e.g., the nucleic acids, vectors, cells, proteins, or polypeptides) and does not negatively affect the subject to which the composition(s) are administered. Any of the compositions to be used in the present methods can comprise pharmaceutically acceptable carriers, excipients, or stabilizers in the form of lyophilized formations or aqueous solutions.

Nucleic Acids

Also disclosed herein are nucleic acids encoding the engineered nucleases or fusion proteins as described herein. The nucleic acids may be DNA, RNA, or combinations thereof. In some embodiments, the nucleic acids comprise one or more messenger RNAs, one or more vectors, or any combination thereof.

In certain embodiments, the nucleic acids are engineered for codon-optimization. It will be appreciated altering codons to those most frequently used in the cells or subject of interest allows for maximum expression. Such modified nucleic acid sequences are commonly described in the art as "codon-optimized." In some embodiments, the nucleic acid sequence is considered codon-optimized if at least about 60% (e.g., about 65%, about 70%, about 75%, about 80%, about 85%, about 90%, about 95%, or about 98%) of the codons encoded therein are preferred codons to the subject of interest.

The present disclosure also provides for DNA segments encoding the engineered nucleases or fusion proteins disclosed herein, vectors containing these segments, and cells containing the vectors. The vectors may be used to propagate the DNA segment in an appropriate cell and/or to allow expression from the segment (e.g., an expression vector). The person of ordinary skill in the art would be aware of the various vectors available for propagation and expression of a nucleic acid sequence.

The present disclosure further provides engineered, non-naturally occurring vectors and vector systems, which can encode the engineered nucleases, fusion proteins, or one or more or all of the components of the systems or compositions, as disclosed herein. The vector(s) can be introduced into a cell that is capable of expressing the polypeptide encoded thereby, including any suitable prokaryotic or eukaryotic cell.

The vectors of the present disclosure may be delivered to a eukaryotic cell. Modification of the eukaryotic cells via the present system can take place in a cell culture, where the method comprises isolating the eukaryotic cell from a subject prior to the modification. In some embodiments, the method further comprises returning said eukaryotic cell and/or cells derived therefrom to the subject.

Viral and non-viral based gene transfer methods can be used to introduce nucleic acids encoding components of the present system into cells, tissues, or a subject. Such methods can be used to administer nucleic acids encoding components of the present system to cells in culture, or in a host organism. Non-viral vector delivery systems include DNA plasmids, cosmids, RNA (e.g., a transcript of a vector described herein), a nucleic acid, and a nucleic acid complexed with a delivery vehicle. Viral vector delivery systems include DNA and RNA viruses, which have either episomal or integrated genomes after delivery to the cell. Viral vectors include, for example, retroviral, lentiviral, adenoviral, adeno-associated and herpes simplex viral vectors.

In certain embodiments, plasmids that are non-replicative, or plasmids that can be cured by high temperature may be used, such that any or all of the necessary components of the system may be removed from the cells under certain conditions. For example, this may allow for DNA integration by transforming bacteria of interest, but then being left with engineered strains that have no memory of the plasmids or vectors used for the integration.

Drug selection strategies may be adopted by positively selecting for cells that underwent DNA integration. A donor nucleic acid may contain one or more drug-selectable markers within the cargo. Then presuming that the original donor plasmid is removed, drug selection may be used to enrich for integrated clones. Colony screenings may be used to isolate clonal events.

A variety of viral constructs may be used to deliver the engineered nucleases, fusion proteins, or one or more or all of the components of the system or compositions to the targeted cells and/or a subject. Nonlimiting examples of such recombinant viruses include recombinant adeno-associated virus (AAV), recombinant adenoviruses, recombinant lentiviruses, recombinant retroviruses, recombinant herpes simplex viruses, recombinant poxviruses, phages, etc. The present disclosure provides vectors capable of integration in the host genome, such as retrovirus or lentivirus. See, e.g., Ausubel et al., Current Protocols in Molecular Biology, John Wiley & Sons, New York, 1989; Kay, M. A., et al., 2001 Nat. Medic. 7 (1): 33-40; and Walther W. and Stein U., 2000 Drugs, 60 (2): 249-71; incorporated herein by reference.

In one embodiment, a DNA segment encoding an engineered nuclease, fusion protein, or one or more or all of the components of the system or compositions is contained in a plasmid vector that allows expression of the protein(s) and subsequent isolation and purification produced by the recombinant vector. Accordingly, the proteins disclosed herein can be purified following expression, obtained by chemical synthesis, or obtained by recombinant methods.

To construct cells that express an engineered nuclease, fusion protein, or one or more or all of the components of the system or compositions, expression vectors for stable or transient expression may be constructed via conventional methods as described herein and introduced into cells. For example, nucleic acids encoding an engineered nuclease, fusion protein, or one or more or all of the components of the system or compositions may be cloned into a suitable expression vector, such as a plasmid or a viral vector in operable linkage to a suitable promoter. The selection of expression vectors/plasmids/viral vectors should be suitable for integration and replication in eukaryotic cells.

In certain embodiments, vectors of the present disclosure can drive the expression of one or more sequences in prokaryotic cells. Promoters that may be used include T7 RNA polymerase promoters, constitutive E. coli promoters, and promoters that could be broadly recognized by transcriptional machinery in a wide range of bacterial organisms. The system may be used with various bacterial hosts.

In certain embodiments, vectors of the present disclosure can drive the expression of one or more sequences in mammalian cells using a mammalian expression vector. Examples of mammalian expression vectors include pCDM8 (Seed, Nature (1987) 329:840, incorporated herein by reference) and pMT2PC (Kaufman, et al., EMBO J. (1987) 6:187, incorporated herein by reference). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd eds., Cold Spring Harbor Laboratory, Cold Spring Harbor Laboratory Press, Cold Spring Harbor, N.Y., 1989, incorporated herein by reference.

Vectors of the present disclosure can comprise any of a number of promoters known to the art, wherein the promoter is constitutive, regulatable or inducible, cell type specific, tissue-specific, or species specific. In addition to the sequence sufficient to direct transcription, a promoter sequence of the invention can also include sequences of other regulatory elements that are involved in modulating transcription (e.g., enhancers, Kozak sequences and introns). Many promoter/regulatory sequences useful for driving constitutive expression of a gene are available in the art and include, but are not limited to, for example, CMV (cytomegalovirus promoter), EF1a (human elongation factor 1 alpha promoter), SV40 (simian vacuolating virus 40 promoter), PGK (mammalian phosphoglycerate kinase promoter), Ubc (human ubiquitin C promoter), human beta-actin promoter, rodent beta-actin promoter, CBh (chicken beta-actin promoter), CAG (hybrid promoter contains CMV enhancer, chicken beta actin promoter, and rabbit beta-globin splice acceptor), TRE (Tetracycline response element promoter), H1 (human polymerase III RNA promoter), U6 (human U6 small nuclear promoter), and the like. Additional promoters that can be used for expression of the components of the present system, include, without limitation, cytomegalovirus (CMV) intermediate early promoter, a viral LTR such as the Rous sarcoma virus LTR, HIV-LTR, HTLV-1 LTR, Maloney murine leukemia virus (MMLV) LTR, mycoloproliferative sarcoma virus (MPSV) LTR, spleen focus-forming virus (SFFV) LTR, the simian virus 40 (SV40) early promoter, herpes simplex tk virus promoter, elongation factor 1-alpha (EF1-α) promoter with or without the EF1-α intron. Additional promoters include any constitutively active promoter. Alternatively, any regulatable promoter may be used, such that its expression can be modulated within a cell.

Moreover, inducible and tissue specific expression can be accomplished by placing the nucleic acid encoding such a molecule under the control of an inducible or tissue specific promoter/regulatory sequence. Examples of tissue specific or inducible promoter/regulatory sequences which are useful for this purpose include, but are not limited to, the rhodopsin promoter, the MMTV LTR inducible promoter, the SV40 late enhancer/promoter, synapsin 1 promoter, ET hepatocyte promoter, GS glutamine synthase promoter and many others. In addition, promoters which are well known in the art can be induced in response to inducing agents such as metals, glucocorticoids, tetracycline, hormones, and the like, are also contemplated for use with the invention. Thus, it will be appreciated that the present disclosure includes the use of any promoter/regulatory sequence capable of driving expression of the desired protein operably linked thereto.

The vectors of the present disclosure may direct expression of the nucleic acid in a particular cell type (e.g., tissue-specific regulatory elements are used to express the nucleic acid). Such regulatory elements include promoters that may be tissue specific or cell specific. The term "tissue specific" as it applies to a promoter refers to a promoter that is capable of directing selective expression of a nucleotide sequence of interest to a specific type of tissue (e.g., seeds) in the relative absence of expression of the same nucleotide sequence of interest in a different type of tissue. The term "cell type specific" as applied to a promoter refers to a promoter that is capable of directing selective expression of a nucleotide sequence of interest in a specific type of cell in the relative absence of expression of the same nucleotide sequence of interest in a different type of cell within the same tissue. The term "cell type specific" when applied to a promoter also means a promoter capable of promoting selective expression of a nucleotide sequence of interest in a region within a single tissue. Cell type specificity of a promoter may be assessed using methods well known in the art, e.g., immunohistochemical staining.

Additionally, the vector may contain, for example, some or all of the following: a selectable marker gene, such as the neomycin gene for selection of stable or transient transfectants in host cells; enhancer/promoter sequences from the immediate early gene of human CMV for high levels of transcription; transcription termination and RNA processing signals from SV40 for mRNA stability; 5'- and 3'-untranslated regions for mRNA stability and translation efficiency from highly-expressed genes like α-globin or β-globin; SV40 polyoma origins of replication and ColE1 for proper episomal replication; internal ribosome binding sites (IRESes), versatile multiple cloning sites; T7 and SP6 RNA promoters for in vitro transcription of sense and antisense RNA; a "suicide switch" or "suicide gene" which when triggered causes cells carrying the vector to die (e.g., HSV thymidine kinase, an inducible caspase such as iCasp9), and reporter gene for assessing expression of the chimeric receptor. Suitable vectors and methods for producing vectors containing transgenes are well known and available in the art. Selectable markers also include chloramphenicol resistance, tetracycline resistance, spectinomycin resistance, streptomycin resistance, erythromycin resistance, rifampicin resistance, bleomycin resistance, thermally adapted kanamycin resistance, gentamycin resistance, hygromycin resistance, trimethoprim resistance, dihydrofolate reductase (DHFR), GPT; the URA3, HIS4, LEU2, and TRP1 genes of *S. cerevisiae*.

When introduced into the cell, the vectors may be maintained as an autonomously replicating sequence or extrachromosomal element or may be integrated into host DNA.

The proteins (e.g., engineered nucleases, fusion protein, effector domains), polynucleotides encoding these proteins, and systems and compositions comprising the proteins and/or polynucleotides described herein may be delivered by any suitable means. In certain embodiments, the delivery is in vivo. In other embodiments, the delivery is to isolated/cultured cells (e.g., autologous iPS cells) in vitro to provide modified cells useful for in vivo delivery to patients afflicted with a disease or condition.

Vectors according to the present disclosure can be transformed, transfected, or otherwise introduced into a wide variety of cells. Transfection refers to the taking up of a vector by a cell whether or not any coding sequences are in fact expressed. Numerous methods of transfection are known to the ordinarily skilled artisan, for example, lipofectamine, calcium phosphate co-precipitation, electroporation, DEAE-dextran treatment, microinjection, viral infection, and other methods known in the art. Transduction refers to entry of a virus into the cell and expression (e.g., transcription and/or translation) of sequences delivered by the viral vector genome. In the case of a recombinant vector, "transduction" generally refers to entry of the recombinant viral vector into the cell and expression of a nucleic acid of interest delivered by the vector genome.

Any of the vectors comprising a nucleic acid sequence that encodes an engineered nuclease, fusion protein, or one or more or all of the components of the system or compositions is also within the scope of the present disclosure. Such a vector may be delivered into host cells by a suitable method. Methods of delivering vectors to cells are well known in the art and may include DNA or RNA electroporation, transfection reagents such as liposomes or nanoparticles to delivery DNA or RNA; delivery of DNA, RNA, or protein by mechanical deformation (see, e.g., Sharei et al. Proc. Natl. Acad. Sci. USA 110 (6): 2082-2087 (2013) incorporated herein by reference); or viral transduction. In some embodiments, the vectors are delivered to host cells by viral transduction. Nucleic acids can be delivered as part of a larger construct, such as a plasmid or viral vector, or directly, e.g., by electroporation, lipid vesicles, viral transporters, microinjection, and biolistics (high-speed particle bombardment). Similarly, the construct containing the one or more transgenes can be delivered by any method appropriate for introducing nucleic acids into a cell. In some embodiments, the construct or the nucleic acid encoding the components of the present system is a DNA molecule. In some embodiments, the nucleic acid encoding the components of the present system is a DNA vector and may be electroporated to cells. In some embodiments, the nucleic acid encoding the components of the present system is an RNA molecule, which may be electroporated to cells.

Additionally, delivery vehicles such as nanoparticle- and lipid-based mRNA or protein delivery systems can be used. Further examples of delivery vehicles include lentiviral vectors, ribonucleoprotein (RNP) complexes, lipid-based delivery system, gene gun, hydrodynamic, electroporation or nucleofection microinjection, and biolistics. Various gene delivery methods are discussed in detail by Nayerossadat et al. (Adv Biomed Res. 2012; 1:27) and Ibraheem et al. (Int J Pharm. 2014 Jan. 1; 459 (1-2): 70-83), incorporated herein by reference.

In some embodiments, the engineered nucleases, fusion proteins, or one or more or all of the components of the system or compositions may be mixed, individually or in any combination, with a carrier which are also within the scope of the present disclosure. Exemplary carriers include buffers, antioxidants, preservatives, carbohydrates, surfactants, and the like, and are described in detail elsewhere herein.

Also disclosed are cells comprising the engineered nucleases, fusion proteins, nucleic acids, or one or more or all of the components of the system or compositions described herein. In some embodiments, the cell is a prokaryotic cell. In some embodiments, the cell is a eukaryotic cell. In some embodiments, the cell is a mammalian cell. In some embodiments, the cell is a human cell.

Methods

The disclosure also provides methods of modifying a target nucleic acid sequence. The phrase "modifying a nucleic acid sequence," as used herein, refers to modifying at least one physical feature of a nucleic acid sequence of interest or a functional feature of a nucleic acid sequence. In some embodiments, the nucleic acid alterations include, for example, single or double strand breaks, deletion, or insertion of one or more nucleotides, and other modifications that affect the structural integrity or nucleotide sequence of the nucleic acid sequence.

In some embodiments, the methods introduce a single strand or double strand break in the target nucleic acid sequence. In this respect, the disclosed systems may direct cleavage of one or two strands of a target nucleic acid sequence, such as within a target genomic DNA sequence and/or within the complement of the target sequence.

In some embodiments, altering a nucleic acid sequence comprises a deletion. The deletion may be upstream or downstream of nuclease binding site, so called unidirectional deletions. The deletion may encompass sequences on either side of the binding site, a bidirectional deletion. The deletion of the nucleic sequence may be of any size. The methods can be used to delete nucleic acids from a target sequence in a host cell by cleaving the target sequence and allowing the host cell to repair the cleaved sequence. Deletion of a nucleic acid sequence in this manner can be used in a variety of applications, such as, for example, to remove disease-causing trinucleotide repeat sequences in neurons, to create gene knock-outs or knock-downs, and to generate mutations for disease models in research.

In some embodiments, the systems and methods described herein may be used to insert a gene or fragment thereof into a cell. For example, the systems or methods may include an exogenous nucleic acid molecule which encodes a gene protein (e.g., a nucleic acid encoding a gene or gene product) which is inserted at the site of nucleic acid cleavage.

In some embodiments, the methods do not introduce a single strand or double strand break in the target nucleic acid sequence. The methods may result in modifying the nucleic acid sequence as a result of one of more of the effector or functional domains as described above. For example, the methods may modulate the transcription of a target nucleic acid, may add or remove moieties from the target nucleic acid (e.g., methyl groups), may edit bases in the target nucleic acid (e.g., deaminate, depurinate, depyrimidinate), may unwind, replication, of combine target nucleic acids, and/or may add or remove moieties from histones (e.g., methylate, demethylate, acetylate, deacetylate, ubiquitinate, phosphorylate, sumoylate) bound to the nucleic acid.

The methods comprise contacting a target nucleic acid sequence with an engineered nuclease, fusion protein, composition, or system as described herein. In some embodiments, contacting a target nucleic acid sequence comprises introducing the engineered nuclease, fusion protein, composition, or system into the cell. The engineered nuclease, fusion protein, composition, or system may be introduced into eukaryotic or prokaryotic cells by methods known in the art, as described elsewhere herein.

The cell may be a prokaryotic cell, a plant cell, an insect cell, a vertebrate cell, an invertebrate cell, an animal cell, a mammalian cell, or a human cell. In some embodiments, the cell is a stem cell.

In some embodiments, the cell is ex vivo (e.g., fresh isolate-early passage). In some cases, the cell is in vivo. In some cases, the cell is in culture or in vitro (e.g., immortalized cell line). Cells may be from established cell lines or they may be primary cells, where "primary cells," "primary cell lines," and "primary cultures" are used interchangeably herein to refer to cells and cells cultures that have been derived from a subject and allowed to grow in vitro for a limited number of passages of the culture. For example, primary cultures are cultures that may have been passaged 0 times, 1 time, 2 times, 4 times, 5 times, 10 times, or 15 times, but not enough times go through the crisis stage. Typically, the primary cell lines are maintained for fewer than 10 passages in culture.

In some embodiments, introducing the engineered nuclease, fusion protein, composition, or system into a cell comprises administering the engineered nuclease, fusion protein, composition, or system to a subject. In some embodiments, the subject is human. The administering may comprise in vivo administration of the engineered nuclease, fusion protein, composition, system, or a nucleic acid encoding the engineered nuclease, fusion protein, or system. In alternative embodiments, an in vitro or ex vivo treated cell is transplanted into a subject.

In some embodiments, the target nucleic acid is a nucleic acid endogenous to a target cell. In some embodiments, the target nucleic acid is a genomic DNA sequence. The term "genomic," as used herein, refers to a nucleic acid sequence (e.g., a gene or locus) that is located on a chromosome in a cell.

In some embodiments, the target nucleic acid encodes a gene or gene product. The term "gene product," as used herein, refers to any biochemical product resulting from expression of a gene. Gene products may be RNA or protein. RNA gene products include non-coding RNA, such as tRNA, rRNA, micro RNA (miRNA), and small interfering RNA (siRNA), and coding RNA, such as messenger RNA (mRNA). In some embodiments, the target nucleic acid sequence encodes a protein or polypeptide.

The present methods may be used in various bacterial hosts, including human pathogens that are medically important, and bacterial pests that are key targets within the agricultural industry, as well as antibiotic resistant versions thereof. The method may be designed to target any gene or any set of genes, such as virulence or metabolic genes, for clinical and industrial applications in other embodiments. The present methods may be used to inactivate microbial genes. In some embodiments, the gene is an antibiotic resistance gene. The present methods may be used to treat a multi-drug resistance bacterial infection in a subject. The present methods may also be used for genomic engineering within complex bacterial consortia.

The methods described here also provide for treating a disease or disorder in a subject. The method may comprise administering to the subject, in vivo, an effective amount of the engineered nuclease, fusion protein, composition, or system, or by transplantation of ex vivo treated cells. A "subject" or "patient" may be human or non-human and may include, for example, animal strains or species used as "model systems" for research purposes, such a mouse model as described herein. Within the context of the present disclosure, the term "effective amount" refers to that quantity such that modification of the target nucleic acid is achieved.

In some embodiments, the systems and methods target one or more "disease-associated" genes. The term "disease-associated gene," refers to any gene or polynucleotide whose gene products are expressed at an abnormal level or in an abnormal form in cells obtained from a disease-affected individual as compared with tissues or cells obtained from an individual not affected by the disease. A disease-associated gene may refer to a gene, the mutation or genetic variation of which is directly responsible or is in linkage disequilibrium with a gene(s) that is responsible for the etiology of a disease. In another embodiment, the target genomic DNA sequence can comprise a gene, the mutation of which contributes to a particular disease in combination with mutations in other genes.

When utilized as a method of treatment, the effective amount may depend on the particular condition being treated, the severity of the condition, the individual patient parameters including age, physical condition, size, gender and weight, the duration of the treatment, the nature of concurrent therapy (if any), the specific route of administration and like factors within the knowledge and expertise of the health practitioner. In some embodiments, the effective amount alleviates, relieves, ameliorates, improves, reduces the symptoms, or delays the progression of any disease or disorder in the subject. In some embodiments, the subject is a human.

A wide range of additional therapies may be used in conjunction with the methods of the present disclosure. The additional therapy may be administration of a therapeutic agent or may be an additional therapy not connected to administration of a therapeutic agent. Such additional therapies include, but are not limited to, surgery, immunotherapy, radiotherapy. The additional therapy may be administered at the same time as the above methods. In some embodiments, the additional therapy may precede or follow the treatment of the disclosed methods by time intervals ranging from hours to months.

In some embodiments, effective combination therapy is achieved with a single composition or pharmacological formulation or with two distinct compositions or formulations, administered at the same time or separated by a time interval. The therapeutic agent may comprise any manner of therapeutic, including protein, small molecule, nucleic acids, and the like. For example, therapeutic agents include, but are not limited to, immune modulators, chemotherapeutic agents, a nucleic acid (e.g., mRNA, aptamers, antisense oligonucleotides, ribozyme nucleic acids, interfering RNAs, antigene nucleic acids), decongestants, steroids, analgesics, antimicrobial agents, immunotherapies, or any combination thereof.

In the context of the present disclosure insofar as it relates to any of the disease conditions recited herein, the terms "treat," "treatment," and the like mean to relieve or alleviate at least one symptom associated with such condition, or to slow or reverse the progression of such condition. Within the meaning of the present disclosure, the term "treat" also denotes to arrest, delay the onset (e.g., the period prior to clinical manifestation of a disease) and/or reduce the risk of developing or worsening a disease. For example, in connection with cancer the term "treat" may mean elimination or reduction of a patient's tumor burden, or prevention, delay, or inhibition of metastasis, etc.

The methods disclosed herein are also applicable to plants. For example, the methods can be used to generate novel engineered plants to improve agronomic traits, for example, herbicidal resistance, resistance to environmental stress, resistance to pests, etc.

The disclosed engineered nucleases, fusion proteins, compositions, and systems can be introduced into a plant, or a plant cell, seed, fruit, plant part, or propagation material of the plant. The term "plant propagation material" refers to generative parts of a plant, which can be used for the multiplication of the plant, and vegetative plant material such as cuttings and tubers (e.g., potatoes). In some embodiments, the propagation material is a root, a corm, a tuber, a bulb, a slip, a cutting of the plant, and a rhizome. Parts of a plant are any sections of a plant (e.g., roots, cotyledons, tendrils, leaves, flowers, seeds, stems, callus tissue, nuts, and fruit) that develop from a plant propagation material or grow at a later time. The methods described herein can be used on any plant part. Examples of plant parts include but are not limited to the root, corm, tuber, bulb, slip and rhizome.

Methods of introducing exogenous nucleic acids into plant cells are well known in the art. Such plant cells are considered transformed. DNA constructs can be introduced into plant cells by various methods, including, but not limited to PEG- or electroporation-mediated protoplast transformation, tissue culture or plant tissue transformation by biolistic bombardment, or the *Agrobacterium*-mediated transient and stable transformation.

The transformation can be a transient or a stable transformation. As used herein, the term "stable transformation" is intended to mean that the nucleotide construct introduced into a plant integrates into the genome of the plant and is capable of being inherited by the progeny thereof. "Transient transformation" is intended to mean that a polynucleotide is introduced into the plant and does not integrate into the genome of the plant or a polypeptide is introduced into a plant. In select embodiments, the nucleic acid encoding the RNA hairpin may be stably integrated into the plant genome, for example via *Agrobacterium*-mediated transformation.

Suitable methods also include viral infection (such as double stranded DNA viruses), transfection, conjugation, protoplast fusion, electroporation, particle gun technology, calcium phosphate precipitation, direct microinjection, silicon carbide whiskers technology, *Agrobacterium*-mediated transformation, and the like. The choice of method is generally dependent on the type of cell being transformed and the circumstances under which the transformation is taking place (e.g., in vitro, ex vivo, or in vivo). Transformation methods based upon the soil bacterium *Agrobacterium tumefaciens* are useful for introducing an exogenous nucleic acid molecule into a vascular plant. The wild-type form of *Agrobacterium* contains a Ti (tumor-inducing) plasmid that directs production of tumorigenic crown gall growth on host plants. Transfer of the tumor-inducing T-DNA region of the Ti plasmid to a plant genome requires the Ti plasmid-encoded virulence genes as well as T-DNA borders, which are a set of direct DNA repeats that delineate the region to be transferred. An *Agrobacterium*-based vector is a modified form of a Ti plasmid, in which the tumor inducing functions are replaced by the nucleic acid sequence of interest to be introduced into the plant host.

*Agrobacterium*-mediated transformation generally employs cointegrate vectors or binary vector systems, in which the components of the Ti plasmid are divided between a helper vector, which resides permanently in the *Agrobacterium* host and carries the virulence genes, and a shuttle vector, which contains the gene of interest bounded by T-DNA sequences. A variety of binary vectors are well known in the art and are commercially available, for example, from Clontech (Palo Alto, Calif.). Methods of co-culturing *Agrobacterium* with cultured plant cells or wounded tissue such as leaf tissue, root explants, hypocotyledons, stem pieces or tubers, for example, also are well known in the art. Sec., e.g., Glick and Thompson, (eds.), Methods in Plant Molecular Biology and Biotechnology, Boca Raton, Fla.: CRC Press (1993), incorporated herein by reference.

Microprojectile-mediated transformation also can be used. This method, first described by Klein et al. (Nature 327:70-73 (1987), incorporated herein by reference), relies on microprojectiles such as gold or tungsten that are coated with the desired nucleic acid molecule by precipitation with calcium chloride, spermidine, or polyethylene glycol. The microprojectile particles are accelerated at high speed into an angiosperm tissue using a device such as the BIOLISTIC PD-1000 (Biorad; Hercules Calif.).

As such, the disclosure also provides plants and plant propagation materials (e.g., plant cell, seed, fruit, or plant parts) produced using the methods disclosed herein. Genetically modified, transformed, or transgenic plants include plants into which an exogenous polynucleotide, e.g., a polynucleotide encoding the engineered nuclease or fusion protein disclosed herein, has been introduced.

The methods disclosed herein are suitable for use with any plant, for example, grain crops, fruit crops, forage crops, root vegetable crops, leafy vegetable crops, flowering plants, conifers, trees, oil crops, plants used in phytoremediation, industrial crops, medicinal crops, laboratory model plants, and the like. As such, non-limiting examples of plants that may be used with the present methods include: grains, forage crops, fruits, vegetables, oil seed crops, palms, forestry, vines, maize (corn, *Zea mays*), banana, peanut, field peas, sunflower, tomato, canola, tobacco, wheat, barley, oats, potato, soybeans, cotton, carnations, sorghum, lupin, rice, rutabaga, celery, switchgrass, apple, petunias, *Arabidopsis thaliana*, *Medicago truncatula*, *Medicago sativa*, *Brachypodium distachyon*, *Nicotiana benthamiana*, or *Setaria viridis*.

Kits

Also within the scope of the present disclosure are kits that include the engineered nucleases, fusion proteins, nucleic acids, cells, compositions, systems, or components thereof as disclosed herein.

The kits may contain one or more reagents or other components useful, necessary, or sufficient for practicing any of the methods described herein, such as, transfection or administration reagents, negative and positive control samples (e.g., cells, template DNA), cells, containers housing one or more components (e.g., microcentrifuge tubes, boxes), detectable labels, detection and analysis instruments, software, instructions, and the like.

The kit may include instructions for use in any of the methods described herein. Kits optionally may provide additional components such as buffers and interpretive information. Normally, the kit comprises a container and a label or package insert(s) on or associated with the container. Instructions supplied in the kits of the disclosure are typically written instructions on a label or package insert. In some embodiment, the disclosure provides articles of manufacture comprising contents of the kits described above.

The kits provided herein are in suitable packaging. Suitable packaging includes, but is not limited to, vials, bottles, jars, flexible packaging, and the like. A kit may have a sterile access port (for example, the container may be an intravenous solution bag or a vial having a stopper pierceable by a hypodermic injection needle). The container may also have a sterile access port.

The packaging may be unit doses, bulk packages (e.g., multi-dose packages) or sub-unit doses.

The kit will typically be provided with its various components in one or more packages, e.g., a fiber-based, a cardboard, polymeric, or a Styrofoam box. The enclosure(s) can be configured so as to maintain a temperature differential between the interior and the exterior, for example, to provide insulating properties to keep the reagents at a preselected temperature for a preselected time. The packaging can be air-tight, waterproof (e.g., impermeable to changes in moisture or evaporation), and/or light-tight.

EXAMPLES

The following are examples of the present invention and are not to be construed as limiting.

Materials and Methods

Cell Culture, Plasmid Construction, and Transient Transfection

HEK293T cells (ATCC) were cultured at 37° C. and 5% (v/v) $CO_2$ in high glucose DMEM with 4 mM L-glutamine, 1 mM sodium pyruvate and phenol red pH indicator (Gibco), supplemented with 10% FBS and 1× penicillin-streptomycin. 24 hours prior to transfection, cells were seeded at a density of $10^3$ cells/well in 96 well tissue culture-treated plates.

The guide RNA (gRNA) was cloned into pGuide plasmid with a U6 promoter driving its expression and a CMV-driven GFP transfection reporter using HiFi DNA Assembly protocols (New England Biolabs). Nuclease enzyme constructs were assembled using HiFi DNA Assembly (New England Biolabs) of Gene Fragments (Twist Biosciences) into the pTwist CMV vector.

For each transfection well, 50 ng of gRNA plasmid and 50 ng of nuclease enzyme plasmid or base editor enzyme plasmid were added to 5 µL of Opti-MEM (Gibco). One non-targeting guide RNA negative control was included for each experiment. 0.2 µL of TransIT®-2020 transfection reagent (Mirus Bio) was diluted into 4 µL of Opti-MEM. Plasmid and TransIT®-2020 mixtures were combined, incubated for 15-30 min at room temperature, and added to HEK293T cells in a dropwise manner. Plates were gently rocked to mix and incubated for 72 hours. Guide RNA sequences are listed in Table 1.

Microscopy, Sample Preparation, and Sequencing 72 hours post-transfection, qualitative assessments of transfection efficiency and cell health were made using fluorescence and brightfield microscopy (Revolve Echo). Quantitative transfection efficiency measurements were made using 96 well plate-based fluorescence measurements (Tecan Spark). Culture media was aspirated from cells prior to washing with PBS (Gibco). 35 µL lysis buffer (100 mM Tris-HCl, pH 7.5; 0.05% SDS; 25 µg/mL Proteinase K) was added to each well. The samples were then incubated at 37° C. for 1 hour before being transferred to 96-well PCR plates and boiled at 98° C. for 15 min. Guide-specific primers were used to PCR amplify the genomic target region of interest from the cell lysates (Q5 DNA Polymerase NEB). Five samples per plate were spot-checked via gel electrophoresis to confirm the presence of the expected amplicon size. The Mag-Bind® RxnPure Plus (Omega Bio-tek) PCR clean-up kit was used to purify the PCR products prior to sequencing submission. Once eluted, DNA yields were quantified via the QuantiFluor® kit (Promega). DNA concentrations were normalized to 2 ng/100 bp of amplicon length and submitted to the UC Berkeley Sequencing facility for Sanger sequencing along with the appropriate forward PCR primer. PCR and Sanger sequencing primers are listed in Table 2.

Sequencing Analysis

To determine the editing efficiency of nucleases from Sanger sequencing data, the open source Inference of CRISPR Edits program (ICE) v1.2.0 was used, using default parameters (Conant et al. 2022; liebertpub.com/doi/full/ 10.1089/crispr.2021.0113; github.com/synthego-open/ice). ICE determines potential outcomes for editing with guide RNAs which are supported by the Sanger data via regression. The ICE algorithm produces accurate estimates of editing compared to other Sanger analysis tools, and compared to NGS-based quantification of editing.

For indel quantification, target sites were amplified using a two-step PCR reaction. First, 5 µL of lysate (corresponding to ~ 10,000 cells) was used as a template for PCR with (Platinum™ SuperFi II PCR Master Mix, Thermo Fisher Scientific) unique primer pairs containing an internal locus-specific region and an outer Illumina-compatible adapter sequence (Table 3). The resulting product was then diluted 1:100 in molecular biology grade water and used as a template in a second PCR reaction (Q5® High-Fidelity DNA Polymerase, New England Biolabs) targeting the outer-adapter sequence, appending unique indices to each amplicon for pooled sequencing (xGen™ UDI 10 nt Primer Plates 1-16, Catalog number: 10008054, Integrated DNA Technologies). Amplicons were pooled 1:1 and sequenced on a NovaseqX with 2×151 paired end reads (Seqmatic). All amplicons across experiments included reference samples that were not treated with active nuclease to control for any variant reads relative to reference genome that are not due to gene editing. After de-multiplexing, ~ 0.025M-6M reads per amplicon were obtained. Reads were trimmed and filtered using fastp removing ~2-5% of reads per sample. Next, CRISPResso2 v2.2.24 was run in "CRISPRessoBatch" mode with default parameters using the processed reads, amplicon sequences, and spacer sequences as input. For off-target sites, spacer sequences were edited to match the corresponding region on the amplicon. The indel rate was computed as the percentage of aligned reads having an insertion or deletion within one bp of the cleavage site. Eight amplicons which displayed low read quality, low alignment rates, high rates of substitutions, or high rates of editing at negative controls were excluded.

To quantify base editing efficiency from Sanger sequencing data, an open source program called Beat was used using default parameters (Xu et al. CRISPR J 2019). Beat is a Python-based program that determines editing efficiency after subtracting the background noise and without the need to normalize to control samples. Beat produces results that are concordant with EditR (another commonly used software for base editing) and agree with base editing quantification based on NGS.

TABLE 1

| Guide RNA ID | Guide sequence | SEQ ID NO |
|---|---|---|
| HEK3-gRNA | GGCCCAGACUGAGCACGUGA | 400 |
| CD3G_1-gRNA | ACAUACUUCUGUAAUACACU | 401 |
| HEK2-gRNA | GAACACAAAGCAUAGACUGC | 402 |
| Non-targeting-gRNA control | GAGCAGAUCGUUGAUUGUAG | 403 |

TABLE 1-continued

| Guide RNA ID | Guide sequence | SEQ ID NO |
|---|---|---|
| AAVS1-on | GGGGCCACUAGGGACAGGAU | 413 |
| AAVS1-off1 | GGGGCCACUAGGGACAGGAU | 414 |
| AAVS1-off2 | GGGGCCACUAGGGACAGGAU | 415 |
| AAVS1-off3 | GGGGCCACUAGGGACAGGAU | 416 |
| FANCF-on | GGAAUCCCUUCUGCAGCACC | 417 |
| FANCF-off1 | GGAAUCCCUUCUGCAGCACC | 418 |
| FANCF-off2 | GGAAUCCCUUCUGCAGCACC | 419 |
| FANCF-off3 | GGAAUCCCUUCUGCAGCACC | 420 |
| VEGFA-on | GGGUGGGGGGAGUUUGCUCC | 421 |
| VEGFA-off1 | GGGUGGGGGGAGUUUGCUCC | 422 |
| VEGFA-off2 | GGGUGGGGGGAGUUUGCUCC | 423 |
| VEGFA-off3 | GGGUGGGGGGAGUUUGCUCC | 424 |
| HEK2-on | GAACACAAAGCAUAGACUGC | 425 |
| HEK2-off1 | GAACACAAAGCAUAGACUGC | 426 |
| HEK2-off2 | GAACACAAAGCAUAGACUGC | 427 |
| HEK3-on | GGCCCAGACUGAGCACGUGA | 428 |
| HEK3-off1 | GGCCCAGACUGAGCACGUGA | 429 |
| HEK3-off2 | GGCCCAGACUGAGCACGUGA | 430 |
| HEK3-off3 | GGCCCAGACUGAGCACGUGA | 431 |
| T39 | GGACAGCUUUUCCUAGACAG | 432 |

TABLE 2

| PCR and Sanger Sequencing Primer | Sequence | SEQ ID NO: |
|---|---|---|
| HEK3 forward | ATGTGGGCTGCCTAGAAAGG | 404 |
| HEK3 reverse | CCCAGCCAAACTTGTCAACC | 405 |
| CD3G_1 forward | GACGCAGATATTGGCGTCAC | 406 |
| CD3G_1 reverse | GGAAGCCCATGTAGTCTAACTACC | 407 |
| HEK2 forward | CTGGTGGTACTTGAATCAAGCAC | 408 |
| HEK2 reverse | GAAGGAGACTTGTGCACATTCTATAG | 409 |
| T39 forward | GCCTGTGATGGGCTAATTGATG | 433 |
| T39 reverse | GTCTCTGACCACTGCGATATG | 434 |

TABLE 3

| Illumina NGS Sequencing Primer | Sequence | SEQ ID NO: |
|---|---|---|
| AAVS1-on_fwd | CACTCTTTCCCTACACGACGCTCTTCCGATCTACAGGAGGTGGGGGTTAGAC | 435 |

TABLE 3-continued

| Illumina NGS Sequencing Primer | Sequence | SEQ ID NO: |
|---|---|---|
| AAVS1-on_rev | GGAGTTCAGACGTGTGCTCTTCCGATCTCGGTTAATGTGGCTCTGGTT | 436 |
| AAVS1-off1_fwd | CACTCTTTCCCTACACGACGCTCTTCCGATCTAACACCACCACTGCTTACCC | 437 |
| AAVS1-off1_rev | GGAGTTCAGACGTGTGCTCTTCCGATCTTCCATTAAGTTCCAGGGGTG | 438 |
| AAVS1-off2_fwd | CACTCTTTCCCTACACGACGCTCTTCCGATCTAGAGGTCACCCTCACCACAC | 439 |
| AAVS1-off2_rev | GGAGTTCAGACGTGTGCTCTTCCGATCTTGTTCACAGCTTGTAGGCCA | 440 |
| AAVS1-off3_fwd | CACTCTTTCCCTACACGACGCTCTTCCGATCTCTTGGCTCCTTCGTTACAGC | 441 |
| AAVS1-off3_rev | GGAGTTCAGACGTGTGCTCTTCCGATCTGGTAGATGGGCAACCAACTC | 442 |
| FANCF-on_fwd | CACTCTTTCCCTACACGACGCTCTTCCGATCTCTTGCCTCCACTGGTTGTG | 443 |
| FANCF-on_rev | GGAGTTCAGACGTGTGCTCTTCCGATCTGCCGTCTCCAAGGTGAAA | 444 |
| FANCF-off1_fwd | CACTCTTTCCCTACACGACGCTCTTCCGATCTGCCTGCTGCACTCTCTGAGTA | 445 |
| FANCF-off1_rev | GGAGTTCAGACGTGTGCTCTTCCGATCTCACAGATTGATGCCACTGGA | 446 |
| FANCF-off2_fwd | CACTCTTTCCCTACACGACGCTCTTCCGATCTCGAACTCCTGGGGCTTCT | 447 |
| FANCF-off2_rev | GGAGTTCAGACGTGTGCTCTTCCGATCTGTGGGGAGGGAGAGCAGT | 448 |
| FANCF-off3_fwd | CACTCTTTCCCTACACGACGCTCTTCCGATCTGTGACCCAGGTCCAGTGTTT | 449 |
| FANCF-off3_rev | GGAGTTCAGACGTGTGCTCTTCCGATCTTGAGACCTCTGACCTCCACA | 450 |
| VEGFA-on_fwd | CACTCTTTCCCTACACGACGCTCTTCCGATCTCCAGATGGCACATTGTCAGA | 451 |
| VEGFA-on_rev | GGAGTTCAGACGTGTGCTCTTCCGATCTGCTAAAGAGGGAATGGGCTT | 452 |
| VEGFA-off1_fwd | CACTCTTTCCCTACACGACGCTCTTCCGATCTCATCAGGCAATGAGTCAGGA | 453 |
| VEGFA-off1_rev | GGAGTTCAGACGTGTGCTCTTCCGATCTTCTTAGGAGGTTGGGTGTGC | 454 |
| VEGFA-off2_fwd | CACTCTTTCCCTACACGACGCTCTTCCGATCTTCTATCCTTTCCAAGGGCAA | 455 |
| VEGFA-off2_rev | GGAGTTCAGACGTGTGCTCTTCCGATCTTCAATAACAAGGCTCCCAGG | 456 |
| VEGFA-off3_fwd | CACTCTTTCCCTACACGACGCTCTTCCGATCTGTGAAGCGTGACACTCCCTT | 457 |
| VEGFA-off3_rev | GGAGTTCAGACGTGTGCTCTTCCGATCTTGCTCAGTCCAGAGCTCTTCT | 458 |
| HEK2-on_fwd | CACTCTTTCCCTACACGACGCTCTTCCGATCTCCAGCCCCATCTGTCAAACT | 459 |
| HEK2-on_rev | GGAGTTCAGACGTGTGCTCTTCCGATCTTGAATGGATTCCTTGGAAACAATGA | 460 |
| HEK2-off1_fwd | CACTCTTTCCCTACACGACGCTCTTCCGATCTGTGTGGAGAGTGAGTAAGCCA | 461 |

TABLE 3-continued

| Illumina NGS Sequencing Primer | Sequence | SEQ ID NO: |
|---|---|---|
| HEK2-off1_rev | GGAGTTCAGACGTGTGCTCTTCCGATCTACGGTAGGATGATTTCAGGCA | 462 |
| HEK2-off2_fwd | CACTCTTTCCCTACACGACGCTCTTCCGATCTTTTTTGGTACTCGAGTGTTATTCAG | 463 |
| HEK2-off2_rev | GGAGTTCAGACGTGTGCTCTTCCGATCTCACAAAGCAGTGTAGCTCAGG | 464 |
| HEK3-on_fwd | CACTCTTTCCCTACACGACGCTCTTCCGATCTATGTGGGCTGCCTAGAAAGG | 465 |
| HEK3-on_rev | GGAGTTCAGACGTGTGCTCTTCCGATCTCCCAGCCAAACTTGTCAACC | 466 |
| HEK3-off1_fwd | CACTCTTTCCCTACACGACGCTCTTCCGATCTTCCCCTGTTGACCTGGAGAA | 467 |
| HEK3-off1_rev | GGAGTTCAGACGTGTGCTCTTCCGATCTCACTGTACTTGCCCTGACCA | 468 |
| HEK3-off2_fwd | CACTCTTTCCCTACACGACGCTCTTCCGATCTTTGGTGTTGACAGGGAGCAA | 469 |
| HEK3-off2_rev | GGAGTTCAGACGTGTGCTCTTCCGATCTCTGAGATGTGGGCAGAAGGG | 470 |
| HEK3-off2_fwd | CACTCTTTCCCTACACGACGCTCTTCCGATCTTTGGTGTTGACAGGGAGCAA | 471 |
| HEK3-off2_rev | GGAGTTCAGACGTGTGCTCTTCCGATCTCTGAGATGTGGGCAGAAGGG | 472 |
| HEK3-off3_fwd | CACTCTTTCCCTACACGACGCTCTTCCGATCTTGAGAGGGAACAGAAGGGCT | 473 |
| HEK3-off3_rev | GGAGTTCAGACGTGTGCTCTTCCGATCTGTCCAAAGGCCCAAGAACCT | 474 |

Sequences

| SEQ ID NO | Nuclease Sequence |
|---|---|
| 1 | MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRENTERDENDKVIRDVKVITLKSNLVSQFRKDFELHKVREINDYHHAHDAYLNAVIGNALLVKYPQLEPEFVYGKFKHFGHKENKATAKKFFYSNIMALFKKDVEYSDDTGEMVWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD |
| 2 | MKKSYSIGLDIGTNSVGWSVVTDDYKVPAKKMKVFGNTDKKYIKKNLLGALLFDSGETAEGTRLKRTARRRYTRRRNRILYLQEIFAKEMAKVDESFFQRLEESFLTDDDKNFDSHPIFGNKAEEDAYHEQFPTIYHLRKHLADSSEKADLRLVYLALAHMIKFRGHFLIEGQLKAENTNVQTLFNDFVEVYDKTVEESHLAEITVDALSILTEKVSKSRRLENLLKYYPTEKKNTLFGNLIALSLGLQPNFKTNFKLSEDAKLQFSKDTYEEDLEELLGKIGDEYADLFTSAKNLYDAILLSGILTVDDKSTKAPLSASMLKRYVEHHEDLEKLKDFVKANKPELYHDIFKDETKNGYAGYIENGVKQDEFYKYLKNTLSKIAGSDYFLDKIERE |

-continued

Sequences

| SEQ ID NO | Nuclease Sequence |
|---|---|
|  | DFLRKQRTFDNGSIPHQVHLQEMRAILRRQGEYYPFLKENQAKIEKILTFRIPYYVGPLARKDSRFA<br>WAEYHSDEKITPWNFDKVIDKESSARAFIEHMTNNDLYLPEEKVLPKHSPLYEKYTVYNELTKVK<br>YVTEQGKSSFFDANMKQEIFEHVFKKNRKVTKDKFLNYLNKEFPEYRIHDLIGLDKENKSFNASLG<br>TYHDLKKILDKSFLDNKENEEIIEDVVLTLTLFEDRDMIRQRLQKYSDIFTKDQLKKLERRHYTGW<br>GRLSYKLINGIRDKQSNKTILDYLLEDDGVKKNINRNFMQLINDDSLSFKTIIQEAQVIGDIDDIKAV<br>VHDLPGSPAIKKGILQSVKIVDELVKVMGHNPDNIVIEMARENQTTNRGRSQSQQRLKKLQESLKE<br>LGSNILNEEKPSYIEDKVENSHLQNDRLFLYYIQNGKDMYTGDELDIDHLSDYDIDHIIPQAFIKDNS<br>IDNRVLTSSAKNRGKSDDVPSLDIVRERKADWIRLYKAGLISKRKFDNLTKAERGGLTENDKAGFI<br>KRQLVETRQITKHVAQILDARFNTKRDENDKVIRDVKIITLKSNLVSQFRKEFGFYKVREINDYHHA<br>HDAYLNAVVGTALIKKYPKLESEFVYGDYKVYDVRKMIAKSEQEIGKATAKRFFYSNIMNFFKTEI<br>KLANGEIRKRPLIETNEETGEVVWNKERDFAIVRKVLSCPQVNIVKKTEVQTGGFSKESILPKRNSD<br>KLIARKKDWDPKKYGGFDSPTVAYSVLVVAKVEKGKSKKLKSVKELLGITIMERSSFEKNPIDFLE<br>AKGYKEVKKDLIIKLPKYSLFELENGRKRMLASAGELQKGNELALPSKYVNFLYLASHYEKLKGSP<br>EDNEQKQLFVEQHKHYLDEIIEQISEFSKRVILADANLDKVLSAYNKHRDKPIREQAENIIHLFTLTN<br>LGAPAAFKYFDTTIDRKRYTSTKEVLDATLIHQSITGLYETRIDLSQLGGD |
| 3 | MNKPYSIGLDIGTNSVGWSVVDDDYKVPAKKMRVFGDTDKGHIKKNLLGTLLFDSGETAESRRLK<br>RTARRRYTRRRNRILYLQEIFAKEMAKVDESFFHRLDESFLTDDDKTFDSHPIFGNKAEEDAYHQQ<br>FPTIYHLRKHLADSTEKADLRLVYLALAHMIKFRGHFLIEGELNAENTDVQKLFADFVGVYDRTFD<br>DSHLSEITVDASSILTEKISKSRRLEKLIKHYPTEKKNTLFGNLVALALGLQPNFKTNFKLSEDAKLQ<br>FSKDTYEEDLEELLGKIGDDYADLFTSAKNLYDAILLSGILTVDDESTKAPLSASMIKRYAEHHEDL<br>EKLKEFVKANKPELYHDIFKDESKNGYAGYIENGVKQDEFYKYLKETLSKQDGSQYFLDKIEREDF<br>LRKQRTFDNGSIPHQLHLKEMRSILHRQGEYYPFLKENQAKIEKILTFRIPYYVGPLARKDSRFAWA<br>EYHSDEPITPWNFDEVVDKEKSAEKFITRMTLNDLYLPEEKVLPKHSHVYETYTVYNELTKVKYV<br>NEQGEAKFFDANMKQEIFDHVFKENRKVTKDKLMDFLGKEFDEFRIVDITGLDKENKAFNASLGT<br>YHDLKKILDKSFLDDKENETIIEDIIQTLTLFEDRDMIRQRLQKYSDIFTPQQLKKLERRHYTGWGRL<br>SYKLINGIRDKQTGKTILDYLIDDGYANRNFMQLINDDTLPFKEIIQKAQIIGDIDDIKAVVHDLPGSP<br>AIKKGILQSVKIVDELVKVMGHNPDNIVIEMARENQTTNRGRTQSQQRLKKLQESLKELGSNILNE<br>KKPSYVEDKVENTHLQNDRLFLYYIQNGKDMYTGDELDIDHLSDYDIDHIIPQAFIKDDKENKAFVLT<br>SSAKNRGKSDDVPSIEIVRDRKADWMRLRKAGLISKRKFDNLTKAERGGLTEADKAGFIKRQLVET<br>RQITKHVAQILDSRENTERDENDKVIREVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEIKLANGE<br>IRKRPLIETNEETGEIVWNKEKDFATVRKVLSCPQVNIVKKTEVQTGGFSKESILPKRNSDKLIARKK<br>DWDPKKYGGFDSPTVAYSVLVVAKVEKGKSKKLKSVKELLGITIMERSSFEKNPIDFLEAKGYKEV<br>KKDLIIKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDATLIHQSITGLYETRIDLSQLGGD |
| 4 | MKKPYSIGLDIGTNSVGWAVVTDDYKVPAKKMKVLGDTDKSHIKKNLLGTLLFESGETAEGRRLK<br>RTARRRYTRRRNRILYLQEIFAEEMNKVDDSFFQRLDESFLKDDDKNFDSHPIFGNKAEEDAYHQK<br>FPTIYHLRQYLADSPEKADLRLVYLALAHIIKYRGHELFEGDLKSENKDVQHLFNDFVEMEDKTVE<br>GSYLSENLPNVADVLVEKVSKSRRLENVLHYFPNEKKNGLFGNFIALALGLQPNFKTNFKLSEDAK<br>LQFSKDTYDEDLEELLGKIGDDYADLFVAAKNLYDAILLSGILTVTDPTTKAPLSASMIDRYEKHH<br>KDLALLKNLIKQNLTQEKYDEVFSDESKNGYAGYISGKVKQEEFYKYLKNTLSKIEGSDYFLDKIE<br>REDFLRKQRTFDNGSIPHQIHLQEMNAIIRRQGEHYPFLKENKEKIEKILTFRIPYYVGPLARGNRDF<br>AWLTRNSDQAIRPWNFEEIVDQASSAEDFINKMTNYDLYLPEEKVLPKHSLLYEFTAVYNELTKVK<br>FIAEGLRDYQFLDSGQKKQIVNQLFKEKRKVTEKDIIQYLHNVDGYDGIELKGIEKQFNASLSTYHD<br>LLKIIIKDKEFMDDPKNEEILENIVHTLTIFEDREMIKQRLAQYDSLFDEKVIKALTRRHYTGWGKLS<br>AKLINGIYDKQSKKTILDYLIDDGEINRNFMQLINDDGLSFKDIIQKAQVVGKTNDVKQVVQELPGS<br>PAIKKGILQSIKLVDELVKVMGHAPESIVIEMARENQTTARGKKNSQQRYKRIEDALKNLAPGLDS<br>NILKENPTDNIQLQNDRLFLYYLQNGKDMYTGEALDINQLSNYDIDHIVPQAFIKDDSLDNRVLTSS<br>KDNRGKSDNVPSIEVVQKRKAPFWQQLLDSKLISERKENNLTKAERGGLDERDKVGFIKRQLVETR<br>QITKHVAQILDARFNTEVDENNQRIRKVKIITLKSNLVSNFRKEFGLYKVREINDYHHAHDAYLNA<br>VVAKAILKKYPLEPEFVYGDYQKYDLKRYISRSKDPKDIEKATEKYFFYSNLLNFFKEEVHYADG<br>TIIKRENIEYSNDTGEIAWNKEKDFATVRKVLSCPQVNIVKKTEVQTGGFSKESILPKRNSDKLIARK<br>KDWDPKKYGGFDSPTVAYSVLVVAKVEKGKSKKLKSVKELLGITIMERSSFEKNPIDFLEAKGYKE<br>VKKDLIIKLPKYSLFELENGRKRMLASAGELQKGNELALPSKYVNFLYLASHYEKLKGSPEDNEQK<br>QLFVEQHKHYLDEIIEQISEFSKRVILADANLDKVLSAYNKHRDKPIREQAENIIHLFTLTNLGAPAA<br>FKYFDTTIDRKRYTSTKEVLDATLIHQSITGLYETRIDLSQLGGD |
| 5 | MDKKYSIGLDIGTNSVGWAVITDDYKVPAKKMKVLGNTDKRTIKKNLLGALLFDSGETAEATRLK<br>RTARRRYTRRKNRLRYLQEIFSKEMSNVDANFFYRLEDSFLVPEDKQQERHPIFGNLVEEIEYHKEF<br>PTIYHLRKQLADSKEKADLRLIYLALAHMIKYRGHELFEGDLKSENTDVQRLFKDFVEVYDKTVEG<br>SYLSENLTNVTDVLVEKISKSRRLENILHYFPNEKKNGLFGNFLALALGLQPNFKNNFDLAEEEAKL<br>QISKDTYEEELEVLLAQIGDNYAELFIATKELYDGILLAGILTVTDSSTKAPLSASMIERYENHQGDL<br>AKLKAFIRRFCKETYDEVFSDEVKDGYAGYIEGKTSQEDFYVHLKKLLANLEGADYFLEKINREDL<br>LRKQRTFDNGSIPYQIHLVEMRAILDKQAKFYPFLAKNQDRIEKLLTFRIPYYVGPLARGKSDFAWL<br>SRKSADKITPWNFDEIVDKESSAEAFINRMTNYDLYLPNQKVLPKHSLLYEKFTVYNELTKVKYKT<br>EQGKTAFFDANMKQEIFDGVFKVYRKVTKDKLMDFLEKEFDEFRIVDLMGLDKENKAFNASYGT<br>YHDLRKILDKDFLDNSDNEKILEDIVLTLTLFEDREMIRKRLEKYKDIFTEKQRKQLERRHYTGWG<br>RLSAKLIHGIRNKESRKTILDYLIDDGYSNRNFMQLINDDTLTFKEEIAKAQVVGETDSLKQFISELA<br>GSPAIKKGILQTVKIVDELVKVMGHKPENIVIEMARENQTTQKGQKNSQERMKRIEEGIKELGSQIL<br>KEHPVENTQLQNEKLYLYYLQNGRDMYVDQELDINRLSDYDIDHIIPQAFIKDDSIDNRVLTSSKD<br>NRGKSDNVPSEDVVKKMKNYWRQLLNAKLISQRKFDNLTKAERGGLSELDKVGFIKRQLVETRQI |

| SEQ ID NO | Nuclease Sequence |
|---|---|
|  | TKHVAQILDSRMNTKYDENDKLIRDVKIITLKSKLVSDFRKDFQFYKVREINNYHHAHDAYLNAV<br>VGTALIKKYPKLESEFVYGDYKVYDVQKMIAKSEQEIGKATAKFFFYSNIMNFFKTEITLANGEIRK<br>RPMIETNEETGEIVWDKGRDFATVRKVLCMPQVNIVKKTEVQTGGFSKESILPKRNSDKLIARKKD<br>WDPKKYGGFDSPTVAYSVLVVAKVEKGKSKKLKSVKELLGITIMERSSFEKNPIDFLEAKGYKEVK<br>KDLIIKLPKYSLFELENGRKRMLASAGELQKGNELALPSKYVNFLYLASHYEKLKGSPEDNEQKQL<br>FVEQHKHYLDEIIEQISEFSKRVILADANLDKVLSAYNKHRDKPIREQAENIIHLFTLTNLGAPAAFK<br>YFDTTIDRKRYTSTKEVLDATLIHQSITGLYETRIDLSQLGGD |
| 6 | MTKPYSIGLDIGTNSVGWAVITDSYKVPSKKMKVLGNTSKKYVKKNLLGALLFESGITAEGRRLK<br>RTARRRYTRRRNRILYLQEIFSTEMSKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQDFLDSYNAIFESDL<br>SLENSKQLEEIVKDKISKSAKKDRILKLFPGEKNSGIFSEFLKLIVGNQADFKKYFNLDDQASLHFSK<br>ESYDEDLETLLGHIGDDYSDVFLKAKKLYDAILLSGILTVTDNETEAPLSSAMIMRYKEHEEDLALL<br>KAYIRNISLETYNEVFKDDTKNGYAGYIDKTNQEDFYVYLKKLLTGLEGADYFLEKINREDLLRK<br>QRTFDNGSIPYQIHLQEMRAIIDKQAKFYPFLAKNKERIEKILTFRIPYYVGPLARGNSDFAWSIRKR<br>NEKITPWNFEDVIDKESSAEAFINRMTSFDLYLPEEKVLPKHSLLYETFTVYNELTKVRFIAESMRD<br>YQFLDSKQKKDIVRLYFKGKRKVTDKDIIDYLHAIDGYDGIELKGIEKQFNSSLSTYHDLLNIINDKE<br>FLDDASNEAIIEEIIHTLTIFEDREMIKQRLSKFENIFDKSVLKKLSRRHYTGWGKLSAKLINGIRDEK<br>SGKTILDYLIDDGISNRNFMQLIHDDTLSFKKKIQKAQIIGDQDNIKQVVQSLPGSPAIKKGILQSIKI<br>VDELVKVMGRNPESIVVEMARENQYTNQGKSNSQQRLKRLEESLKELGSKILKENVPAKLSKIDN<br>NALQNERLYLYYLQNGKDMYTGKDLDIDIRLSNYDIDHIIPQAFLKDNSIDNKVLVSSASNRGKSDD<br>VPSLDVVKKRKGFWHQLLKSKLISQRKFDNLTKAERGGLTEDDKAGFIKRQLVETRQITKHVAQIL<br>DSRFNTKRDDNDKVIRDVKIITLKSNLVSQFRKEFGLYKVREINDYHHAHDAYLNAVVATAILKKY<br>PKLEPEFVYGDYQKYDIKKYLASKDDSSLGKATAKMFFYSNLMNFFKKKVRLSDGTVLIRPVIEYS<br>KDTGEIAWNKEKDFATVRKVLSCPQVNIVKKTEVQTGGFSKESILPKRNSDKLIARKKDWDPKKY<br>GGFDSPTVAYSVLVVAKVEKGKSKKLKSVKELLGITIMERSSFEKNPIDFLEAKGYKEVKKDLIIKL<br>PKYSLFELENGRKRMLASAGELQKGNELALPSKYVNFLYLASHYEKLKGSPEDNEQKQLFVEQHK<br>HYLDEIIEQISEFSKRVILADANLDKVLSAYNKHRDKPIREQAENIIHLFTLTNLGAPAAFKYFDTTID<br>RKRYTSTKEVLDATLIHQSITGLYETRIDLSQLGGD |
| 7 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC<br>DKQTGKTILDYLIDDGFANRNFMQLINDDTLPFKQIIQKAQIVGDVDDIEQVVHNLPGSPAIKKGIL<br>QSIKIVDELVKVMGHNPDNIVIEMARENQTTNRGRSQSQQRLKELQESLKELGSNILNEEKPGSYVES<br>KVENSQLQNDRLFLYYIQNGKDMYTGEELDIDRLSDYDIDHIIPQAFIKDDSIDNRVLTSSAKNRGK<br>SDDVPSLEVVKKRKTYWHQLLKAKLISQRKFDNLTKAERGGLTEKDKAGFIKRQLVETRQITKHV<br>AQILDSRFNTKRDENDKVIRDVKITLKSNLVSQFRKDFGFYKVREINDYHHAHDAYLNAVVGTA<br>LLKKYPKLAPEFVYGEYKKYDVRKIVRSKDESSLGKATAKMFFYSNLMNPFFKKEVRLSDGTVIVR<br>PVIEYSKDTGEIAWNKEKDFATVRKVLSCPQVNIVKKTEVQTGGFSKESILPKRNSDKLIARKKDW<br>DPKKYGGFDSPTVAYSVLVVAKVEKGKSKKLKSVKELLGITIMERSSFEKNPIDFLEAKGYKEVKK<br>DLIIKLPKYSLFELENGRKRMLASAGELQKGNELALPSKYVNFLYLASHYEKLKGSPEDNEQKQLF<br>VEQHKHYLDEIIEQISEFSKRVILADANLDKVLSAYNKHRDKPIREQAENIIHLFTLTNLGAPAAFKY<br>FDTTIDRKRYTSTKEVLDATLIHQSITGLYETRIDLSQLGGD |
| 8 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQDFLDSYNAIFESD<br>LSLENSEQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLAT<br>LKQFVRTNLPEKYDEVFSDQSKDGYAGYIDGKTTQEAFYKYIKNLLSKFEGADYFLDKIEREDFLR<br>KQRTFDNGSIPHQIHLQEMNAIIRRQGEHYPFLKENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEGL<br>RDYQFLDSGQKKQIVNQLFKEKRKVTEKDIIHYLHNVDGYDGIELKGIEKQFNASLSTYHDLLKIIK<br>DKEFMDDPKNEEILENVHTLTIFEDREMIKQRLAQYDSLFDEKVIKALTRRHYTGWGKLSAKLIN<br>GICDKQTGKTILDYLIDDGEINRNFMQLIHDDGLSPFKDIIQKAQVVGKTIDDVKQVVQELPGSPAIK<br>GILQSIKIVDELVKVMGHNPENIVVEMARENQFTNQGRRNSQQRYKKIEDAIKNLDSNLNSKILKE<br>YPTNNQALQNDRLFLYYLQNGKDMYTGEELDINQLSNYDIDHIVPQAFIKDDSLDNRVLTSSKDNR<br>GKSDNVPSLEVVQKRKAFWQQLLDSKLISERKENNLTKAERERGGLNELDKVGFIKRQLVETRQIT<br>KHVAQILDARFNTEVNEKGQRIRKVKIITLKSNLVSNFRKEFGLYKVREINDYHHAHDAYLNAVVA<br>KAILKKYPKLEPEFVYGDYKVKRYISRSKDPKEIEKATEKYFFYSNLLNFFKEEVHYADGTIIK<br>RENIEYSKDTGEIAWNKEKDFATVRKVLSCPQVNIVKKTEVQTGGFSKESILPKRNSDKLIARKKD<br>WDPKKYGGFDSPTVAYSVLVVAKVEKGKSKKLKSVKELLGITIMERSSFEKNPIDFLEAKGYKEVK<br>KDLIIKLPKYSLFELENGRKRMLASAGELQKGNELALPSKYVNFLYLASHYEKLKGSPEDNEQKQL<br>FVEQHKHYLDEIIEQISEFSKRVILADANLDKVLSAYNKHRDKPIREQAENIIHLFTLTNLGAPAAFK<br>YFDTTIDRKRYTSTKEVLDATLIHQSITGLYETRIDLSQLGGD |

-continued

| SEQ ID NO | Nuclease Sequence |
|---|---|
| 9 | MNKPYSIGLDIGTNSVGWAVVDDDYKVPAKKMRVFGDTDRSHIKKNLLGTLLFDSGETAEGRRL KRTARRRYTRRRNRILYLQEIFAEEMSKVDDSFFHRLDESFLTDDDKNFDSHPIFGNKAEEDAYHQ KFPTIYHLRKHLADSTEKADLRLVYLALAHMIKFRGHFLIEGQLNAENTDVQKLFADFVGVYDRTF DDSHLSEITVDASSILTEKISKSRRLENLITHYPKEKKNTLFGNLIALALGLQPNFKTNFKLSEDAKL QFSKDTYEEDLEELLGKIGDDYADLFTSAKNLYDAILLSGILTVDDESTKAPLSASMVKRYAEHHE DLEKLKEFIKANKPELYHDIFKDETKNGYAGYIENGVKQDEFYKYLKNTLSKIAGSDYFLDKIERE DFLRKQRTFDNGSIPHQIHLQEMHAILRRQGDYYPFLKENQDRIEKILTFRIPYYVGPLARKDSRFA WANYHSEEKITPWNFDKVIDKEKSAEKFITRMTSNDLYLPEEKVLPKHSLLYETYTVYNELTKVKY VNEQGNATFFDSNIKQEIFEQLFKTKRKVTKKDIINYLENAYCIDDVEIMGVEDRFNASLGTYHDLL KIIQDKSFLDDKKNEEIIEDVVLTLTLFEDRDMIRQRLQKYSDIFTKQQLKKLERRHYTGWGRLSYK LINGIRNKENNKTILDFLIDDGRANRNFMQLINDDSLSFKTIIQEAQVVGDVDDIETVVHDLPGSPAI KKGILQSIKIVDELVKVMGHNPDNIVIEMARENQTTNRGRSQSQQRLKKLQESLKELGSSILNKEKP SYIEDKVENSHLQNDKLFLYYIQNGKDMYTGEELDIDHLSDYDIDHIIPQAFIKDDSIDNRVLTSSAK NRGKSDDVPSLDIVRDRKAEWIRLYKSKLISKRKFDNLTKAERGGLTENDKAGFIKRQLVETRQIT KHVAQILDARFNTERDENDKVIRDVKVITLKSNLVSQFRKEFGFYKVREINDYHHAHDAYLNAVV GTALLKKYPKLAPEFVYGEYQKYDVRKFISTKDKNDIGKATAKYFFYSNLLNFFKEEVRYANGTII VRPVIEYSKDTGEIAWNKEKDFATVRKVLSCPQVNIVKKTEVQTGGFSKESILPKRNSDKLIARKKD WDPKKYGGFDSPTVAYSVLVVAKVEKGKSKKLKSVKELLGITIMERSSFEKNPIDFLEAKGYKEVK KDLIIKLPKYSLFELENGRKRMLASAGELQKGNELALPSKYVNFLYLASHYEKLKGSPEDNEQKQL FVEQHKHYLDEIIEQISEFSKRVILADANLDKVLSAYNKHRDKPIREQAENIIHLFTLTNLGAPAAFK YFDTTIDRKRYTSTKEVLDATLIHQSITGLYETRIDLSQLGGD |
| 10 | MKKPYSIGLDIGTNSVGWAVVTDDDYKVPAKKMKVLGNTNKESIKKNLIGALLFDAGNTAADRRL KRTARRRYTRRRNRILYLQEIFAEEMNKVDESFFHRLDDSFLVPEDKRGSKYPIFATLEEEKEYHKK FPTIYHLRKHLADSKEKADLRLIYLALAHMIKYRGHFLYEESFDIKNNDIQKIFNEFISIYDNTFEGSS LSGQNAQVEAIFTDKISKSAKRERVLKLFPDEKSTGLFSEFLKLIVGNQADFKKHFDLEEKAPLQFS KDTYDEDLENLLGQIGDDFADLFLVAKKLYDAILLSGILTVTDPSTKAPLSASMIERYENHQKDLA ALKQFIQNNLQEKYDEVFSDQSKDGYAGYIDGKTTQEAFYKYIKNLLSKLEGADYFLDKIEREDFL RKQRTFDNGSIPHQIHLQEMNAIIRRQGEHYPFLKENKEKIEKILTFRIPYYVGPLARGNRDFAWLTR NSDQAIRPWNFEEIVDQASSAEDFINKMTNYDLYLPEEKVLPKHSLLYETFAVYNELTKVKFIAEG MRDYQFLDSGQKKKIVSQLFEDKRKVTEKDIIHYLHTIDGYDGIELSGIEKQFNASLSTYHDLLKIIK DKAFLDDSENEAIIEEIIHTLTIFEDREMIKQRLAQYADIFDKSVLKKLARRHYTGWGKLSAKLINGI RDKQSNKTILDYLIDDGKINRNFMQLINDDSLSFKETIQKAQVVGDTDDVKQVVQELPGSPAIKKGI LQSIKIVDELVKVMGHNPDNIVIEMARENQTTNRGRSQSQQRLKKLQDSLKELGSNILNEEKPSYIE DKVENSHLQNDQLFLYYIQNGKDMYTGEELDIDHLSDYDIDHIIPQAFIKDDSIDNRVLTSSAKNRG KSDDVPSLDIVRERKADWIRLYKSKLISKRKFDNLTKAERGGLTEADKAGFIKRQLVETRQITKHV AQILDSRFNTKRDENDKVIRDVKVITLKSNLVSQFRKDFELYKVREINDYHHAHDAYLNAVVGTA LLKKYPKLAPEFVYGEYKKYDIRKFITSSKDKATAKYFFYSNLMNFFKRIIRYSNGKIVVRPVVEYS KDTGEIAWNKEKDFATVRKVLSCPQVNIVKKTEVQTGGFSKESILPKRNSDKLIARKKDWDPKKY GGFDSPTVAYSVLVVAKVEKGKSKKLKSVKELLGITIMERSSFEKNPIDFLEAKGYKEVKKDLIIKL PKYSLFELENGRKRMLASAGELQKGNELALPSKYVNFLYLASHYEKLKGSPEDNEQKQLFVEQHK HYLDEIIEQISEFSKRVILADANLDKVLSAYNKHRDKPIREQAENIIHLFTLTNLGAPAAFKYFDTTID RKRYTSTKEVLDATLIHQSITGLYETRIDLSQLGGD |
| 11 | MKKSYSIGLDIGTNSVGWAVVDDDYKVPAKKMRVFGDTDRSHIKKNLLGTLLFDSGETAESRRLK RTARRRYTRRRNRILYLQEIFAEEMAKVDDSFFHRLDESFLTDDDKTFDSHPIFGNKAEEDAYHQK FPTIYHLRKHLADSTEKADLRLVYLALAHMIKFRGHFLIEGQLNAENTDVQTLFNDFVEVYDKTVE ESHLAEITVDALSILTEKVSKSRRLENLIKYYPTEKKNTLFGNLVALALGLQPNFKTNFKLSEDAKL QFSKDTYEEDLEELLGKIGDEYADLFTSAKNLYDAILLSGILTVDDNSTKAPLSASMIKRYEEHHED LEKLKTFVKANNSDKYHEIFSDKDKNGYAGYIENGVKQDEFYKYLKNTLSKIAGSDYFLDKIERED FLRKQRTFDNGSIPHQIHLQEMHAILRRQGDYYPFLKENQDRIEKILTFRIPYYVGPLARKDSRFAW ANYHSDEPITPWNFDEVVDKEKSAEKFITRMTLNDLYLPEEKVLPKHSHVYETFAVYNELTKIKYV NEQGKSFFFDANMKQEIFDHVFKENRKVTKDKLLDFLNKEFEEFRIVDLIGLDKENKSFNASLGTY HDLKKILDKSFLDDKTNEQIIEDIVLTLTLFEDRDMIRQRLQKKISDIFTKQQLKKLERRHYTGWGRL SYKLINGIRNKENNKTILDFLIDDGRANRNFMQLINDDSLSFKTIIQEAQVVGDVDDIEAVVHDLPG SPAIKKGILQSVKIVDELVKVMGHNPDNIVIEMARENQTTNRGRVQSQQRLKKLQESLKELGSEILN VEKPSYVEGKVENNHLQNDKLFLYYIQNGKDMYTGEELDIDHLSDYDIDHIIPQAFIKDDSIDNRVL TSSAKNRGKSDDVPSLEIVHDRKADWIRLYKSGLISKRKFDNLTKAERGGLTEADKAGFIKRQLVE TRQITKHVAQILDARFNTERDENDKVIRDVKVITLKSNLVSQFRKDFKFYKVREINDYHHAHDAYL NAVVGTALLKKYPKLAPEFVYGEYKKYDIRKFITNSSDKATAKYFFYSNLLNFFKTKVRYADGTIL VRPVIEYSKDTGEIAWNKEKDFATVRKVLSCPQVNIVKKTEVQTGGFSKESILPKRNSDKLIARKKD WDPKKYGGFDSPTVAYSVLVVAKVEKGKSKKLKSVKELLGITIMERSSFEKNPIDFLEAKGYKEVK KDLIIKLPKYSLFELENGRKRMLASAGELQKGNELALPSKYVNFLYLASHYEKLKGSPEDNEQKQL FVEQHKHYLDEIIEQISEFSKRVILADANLDKVLSAYNKHRDKPIREQAENIIHLFTLTNLGAPAAFK YFDTTIDRKRYTSTKEVLDATLIHQSITGLYETRIDLSQLGGD |
| 12 | MKKPYSIGLDIGTNSVGWAVVDDDYKVPAKKMRVFGDTDRSHIKKNLLGTLLFDDGNTAESRRL KRTARRRYTRRRNRILYLQEIFAEEMNKVDESFFHRLDDSFLVPEDKRGSKYPIFATLEEEKEYHKK FPTIYHLRKHLADSKEKTDLRLIYLALAHMIKYRGHFLYEESFDIKNNDIQKIFNEFISLYDNTFEGSS LSGQNAQVEAIFTDKISKSAKRERVLKLFPDEKSTGLFSEFLKLIVGNQADFKKHFDLEEKAPLQFS KDTYDEDLENLLGQIGDDFADLFLVAKKLYDAILLSGILTVTDPSTKAPLSASMIERYENHEEDLAA LKQFVKANLPEKYDEVFSDQSKDGYAGYIDGKTTQEAFYKYIKNLLSKLEGADYFLDKIEREDFLR KQRTFDNGSIPHQIHLQEMNAIRRQGEHYPFLKDNKEKIEKILTFRIPYYVGPLARGNRDFAWLTR NSDQAIRPWNFEEVVDKASSAEDFINKMTNYDLYLPEEKVLPKHSLLYETFAVYNELTKVKFIAEG |

| SEQ ID NO | Nuclease Sequence |
|---|---|
|  | LRDYQFLDSGQKKQIVNQLFKTKRKVTEKDIINYLHKVDGYDGVEISGVEDRFNASLGTYHDLLKI<br>IKDKSFLDDKKNEEIIEDIVLTLTLFEDRDMIRQRLQKYSDIFTPQQLKKLERRHYTGWGRLSYKLIN<br>GIRNKENNKSILDYLIDDGYANRNFMQLINDDTLPFKQIIQKSQVVGDIDDIKTVVHDLPGSPAIKK<br>GILQSVKIVDELVKVMGHNPDNIVIEMARENQTTNRGRSQSQQRLKKLQESLKELGSNILNVEKPS<br>YIEDKVENNHLQNDKLFLYYIQNGKDMYTGEELDIDHLSDYDIDHIIPQAFIKDDSIDNRVLTSSAK<br>NRGKSDDVPSLDIVRGRKAEWIRLYKAKLISQRKFDNLTKAERGGLTENDKAGFIKRQLVETRQIT<br>KHVAQILDARFNTKRDENDKLIREVKVITLKSNLVSQFRKEFGFYKVREINDYHHAHDAYLNAVV<br>GTAILKKYPKLTSEFVYGEYKKYDIRKFIKSDDHSEMGKATAKYFFYSNLLNFFKEEIKYANGKIVV<br>RPVVEYSKDTGEIAWNKEKDFATVRKVLSCPQVNIVKKTEVQTGGFSKESILPKRNSDKLIARKKD<br>WDPKKYGGFDSPTVAYSVLVVAKVEKGKSKKLKSVKELLGITIMERSSFEKNPIDFLEAKGYKEVK<br>KDLIIKLPKYSLFELENGRKRMLASAGELQKGNELALPSKYVNFLYLASHYEKLKGSPEDNEQKQL<br>FVEQHKHYLDEIIEQISEFSKRVILADANLDKVLSAYNKHRDKPIREQAENIIHLFTLTNLGAPAAFK<br>YFDTTIDRKRYTSTKEVLDATLIHQSITGLYETRIDLSQLGGD |
| 13 | MKKPYSIGLDIGTNSVGWTVITDDYKVPAKKMKVLGNTDKSHMKKNLLGALLFDSGNTAENRRL<br>KRTARRRYTRRRNRILYLQEIFAEEMGKVDDSFFHRLEDSFLVVEDKRGERHPIFGNLEEEVKYHE<br>NFPTIYHLRQYLADNPAKADLRLVYLALAHIIKFRGHFLIEGSFDTRNNDVQRLFSEFLSVYDNVFE<br>GSSLSEQNAQVEAILTDKISKSAKRERVLKLFPDEKSTGLFAEFLKLIVGNQADFKKHFDLEEKAPL<br>QFSKDTYDEDLENLLGQIGDDFADLFLVAKKLYDAILLSGILTVTDPSTKAPLSASMIERYESHQKD<br>LAALKQFIQNNLSDKYDEVFSDQSKDGYAGYIDGKTTQEAFYKYVKKLIEKIEGTDYFLDKIKRED<br>LLRKQRTFDNGSIPHQIHLGELRAILRRQGDFYPFLKDNQERIEKILTFRIPYYVGPLARGNNDFAWL<br>TRNSDQAIRPWNFEEVVDKARSAEDFIHRMTSFDLYLPEEKVLPKHSLLYETFTVYNELTKVKFIAE<br>GLRDYQFPLDRGQKKEIVNQLFKEKRKVTKKDIEHYLHTIDGYDGIELKGIEKQFNSSLSTYHDLLKI<br>IKDKEFLDDASNEAILEEIVHTLTIFEDREMIKQRLAQYSAIFDDKVIKALSRRHYTGWGRLSAKLIN<br>GIRDEKSGKTILDYLIDDGLANRNFMQLIHDDSLTFVEEIQKAQVSGQGHSLHEQIANLAGSPAIKK<br>GILQTVKIVDELVKIMGHNPTNIVIEMARENQTTNQGRRNSQQRLKGIEEGMKELGSQILKEHPVEN<br>SQLQNEKLYLYYLQNGRDMYTGQELDINRLSDYDIDHIVPQSFIKDDSIDNRVLTLSNENRGKSDD<br>VPSEEVVKKMKNYWRQLLNVKLITQRKFDNLTKAERGGLSELDKAGFIKRQLVETRQITKHVAQI<br>LDSRMNAKYDENDKLIRDVKIITLKSKLVSDFRKDFQFYKVREINNYHHAHDAYLNAVVGTALIK<br>KYPKLESEFVYGDYKVYDVRKMIAKSEQEIGKATAKYFFYSNIMNFFKTEITLANGEIRKRPVIEAN<br>EETGEIVWDKGRDFTMVRKVLCMPQVNIVKKTEVQTGGFSKESILPKRNSDKLIARKKDWDPKKY<br>GGFDSPTVAYSVLVVAKVEKGKSKKLKSVKELLGITIMERSSFEKNPIDFLEAKGYKEVKKDLIIKL<br>PKYSLFELENGRKRMLASAGELQKGNELALPSKYVNFLYLASHYEKLKGSPEDNEQKQLFVEQHK<br>HYLDEIIEQISEFSKRVILADANLDKVLSAYNKHRDKPIREQAENIIHLFTLTNLGAPAAFKYFDTTID<br>RKRYTSTKEVLDATLIHQSITGLYETRIDLSQLGGD |
| 14 | MDKKYSIGLDIGTNSVGWAVITDDYKVPAKKMKVLGNTDKHTIKKNLLGALLFDSGETAEATRLK<br>RTARRRYTRRKNRIRYLQEIFSEEMGKVDDSFFHRLEDSFYVEEDKKHDRHPIFANLVEEVAYHKN<br>FPTIYHLRKKLVDNPDKVDLRLIYLALAHIVKFRGHFLIEGDFDIKNNDIQKIFNEFLQIYNSIFESNS<br>LQKGNVQVEEILTDKISKSAKRERVLKLFPDEKSTGLFAEFLKLIVGNQADFKKHFDLEEKAPLQFS<br>KDTYDEDLENLLGQIGDDFADLFLVAKKLYDAILLAGILSVDAPGTKAPLSASMIQRFDEHQEDLV<br>RLKAFIRRSLPETYNEVFKDDTKNGYAGYIDGKTNQEDFYAYLKKLLTGLEGADYFLEKINREDLL<br>RKQRTFDNGSIPYQIHLQEMRAILDKQAKFYPFLAKNKERIEKILTFRIPYYVGPLARGNSDFAWSIR<br>KRNEKITPWNFEDVIDKESSAEAFINRMTSFDLYLPEEKVLPKHSLLYETFTVYNELTKVKFIAEGL<br>RDYQFLDAEQKKEIVTLLFKEKRKVTVKDIEHYLHAIDGYDGIELKGIEKQFNSSLSTYHDLLKIIKD<br>KEFMDDAKNEAILENIVHTLTIFEDREMIKQRLAQYASIFDDKVIKALTRRHYTGWGKLSAKLINGI<br>HDKKSGKTILDYLIDDGYTNRNFMQLIHDDGLSFKEIIQKAQVVGKTDNVKQVVQELPGSPAIKKG<br>ILQSIKIVDELVKVMGHAPESIVIEMARENQTTARGKKNSQQRYKRIEDSLKNLASGLDSQILKEHP<br>TDNIQLQNDRLFLYYLQNGRDMYVGQELDINRLSDYDVDHIIPQAFIKDDSIDNRVLTSSKDNRGK<br>SDNVPSEDVVKKMKNYWRQLLNAKLITQRKFDNLTKAERGGLSELDKAGFIKRQLVETRQITKHV<br>AQILDSRMNAKYDENDKLIRDVKIITLKSKLVSDFRKDFQFYKVREINNYHHAHDAYLNAVVGTA<br>LIKKYPKLESEFVYGDYKVYDVRKMIAKSEQEIGKATAKRFFYSNIMNFFKTEITLANGEIRKRPLIE<br>TNEETGEIVWDKGRDFATVRKVLCMPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVKKDLII<br>KLPKYSLFELENGRKRMLASAGELQKGNELALPSKYVNFLYLASHYEKLKGSPEDNEQKQLFVEQ<br>HKHYLDEIIEQISEFSKRVILADANLDKVLSAYNKHRDKPIREQAENIIHLFTLTNLGAPAAFKYFDT<br>TIDRKRYTSTKEVLDATLIHQSITGLYETRIDLSQLGGD |
| 15 | MTKPYSIGLDIGTNSVGWSVITDDYKVPAKKMKVLGNTDKQTIKKNLLGALLFDSGNTAEATRLK<br>RTARRRYTRRRNRILYLQEIFAEEINKIDDSFFQRLDDSFLIVEDKQGSKHPIFGTLQEEKEYHKQFPT<br>IYHLRKQLADSSQKADIRLIYLALAHIIKYRGHELFEGELKSENKDVQHLFNDFVEMEDKTVEGSYL<br>SENLPNVADVLVEKISKSRRLENILQYFPNEKKNGLFGNFLALALGLTPNFKSNFDLAEDAKLQLSK<br>DSYDEDLESLLAQIGDDYSDVFLKAKKLYDAILLSGILTVTDNFLAEDEALPLSSAMIMRYKEHEEDLALL<br>KAYIRNISLDTYNEVFKDDTKNGYAGYIDGKTNQEDFYVYLKKLLAKLEGADYFLEKINREDLLR<br>KQRTFDNGSIPYQIHLGEMRAILDKQAKFYPFLAENQDRIEKILTFRIPYYVGPLARGNSDFAWSIRK<br>RDEKITPWNFEDVIDKESSAEAFINRMTSFDLYLPEEKVLPKHSLLYETFTVYNELTKVKFIAEGLR<br>DYQFLDSEQKKQIVNQLFKEKRKVTEKDIEHYLHTVDGYDGIELKGIEKQFNSSLSTYHDLLKIIKD<br>KEFMDDAKNEAILENIVHTLTIFEDREMIKQRLAQYDSIFDEKVIKALTRRHYTGWGKLSAKLINGI<br>CDKQTGKTILDYLIDDGEMNRNFMQLINDDGLSFKEIIQKAQVVGKTDNVKQVVQELPGSPAIKKG<br>ILQSIKIVDELVKVMGHAPESIVIEMARENQTTARGKKNSQQRYKRIEDSLKNLASGLDSNILKENP<br>TDNIQLQNDRLFLYYLQNGRDMYTGKPLDINQLSSYDIDHIVPQAFIKDDSIDNRVLTSSKDNRGKS<br>DNVPSEEVVKKMKAFWRQLLDAKLISQRKFDNLTKAERGGLTNDDKARFIQRQLVETRQITKHVA<br>RILDERENTETDENNQKIRTVKIVTLKSNLVSNFRKEYQLYKVREINNYHHAHDAYLNAVVAKAIL<br>TKYPQLEPEFVYGDYPKYNSYKTRKSATEKLFFYSNIMNFFKTEILLANGEIRKRPQIETNDETGEIV |

| SEQ ID NO | Nuclease Sequence |
|---|---|
| | WNKCRDFATVRKVLSMPQVNIVKKTEVQTGGFSKESILPKRNSDKLIARKKDWDPKKYGGFDSPT VAYSVLVVAKVEGKSKKLKSVKELLGITIMERSSFEKNPIDFLEAKGYKEVKKDLIIKLPKYSLFE LENGRKRMLASAGELQKGNELALPSKYVNFLYLASHYEKLKGSPEDNEQKQLFVEQHKHYLDEII EQISEFSKRVILADANLDKVLSAYNKHRDKPIREQAENIIHLFTLTNLGAPAAFKYFDTTIDRKRYTS TKEVLDATLIHQSITGLYETRIDLSQLGGD |
| 16 | MKKPYSIGLDIGTNSVGWAVITDSYKVPSKKMKVLGNTSKKYVKKNLLGALLFESGITAEGRRLK RTARRRYTRRRNRILYLQEIFAEEMNKIDESFFHRLDDSFLVPEDKRGSKYPIFATLEEEKEYHKQFP TIYHLRKHLADSKEKTDLRLIYLALAHMIKYRGHFLYEESFDIKNNDIQKIFNEFISIYDNTFEGSSLS GQNAQVEAIFTDKISKSAKRERVLKLFPDEKSTGLFSEFLKLIVGNQADFKKHFDLEEKAPLQFSKD TYDEDLENLLGQIGDDFADLFLVAKKLYDAILLSGILTVTDPSTKAPLSASMIERYENHQKDLAALK QFIQNNLQEKYDEVFSDQSKDGYAGYINGKTTQEAFYKYIKNLLNKVEGADYFLDKIEREDFLRKQ RTFDNGSIPHQIHLQEMHAILQRQGEHYPFLKDNKEKIEKILTFRIPYYVGPLARGNRDFAWLTRNS DQAIRPWNFEEVVDQASSAEDFINKMTNYDLYLPEEKVLPKHSLLYETFAVYNELTKVKFIAEGLR DYQFLDSGQKKQIVNQLFKEKRKVTEKDIIHYLHNVDGYDGIELKGIEKQFNASLATYHDLLKIIKD KEFMDDPKNEEILEKIIHTLTLFEDREMIKQRLEQYADIFDKSVLKKLSRRHYTGWGKLSAKLINGI RDKKTGKTILDYLIDDGYSNRNFMQLINDDSLSFKEKIKEAQRSGEGDDLREEVQNLAGSPAIKKGI LQSLKIVDELIEVMGRDPEHIVVEMARENQFTNQGRRNSQQRYKKLKNAIKNLDNNLNSKILKEYP TNNQALQNDRLFLYYIQNGKDMYTGEELDIDNLSQYDIDHIIPQAFIKDDSIDNRVLTSSAKNRGKS DDVPSIEIVKDRRNFWKQLLDSQLISQRKFDNLTKAERGGLTEADKAGFIKRQLVETRQITKHVAQI LDARFNTKRDENDKVIRDKVITLKSNLVSQFRKDFQFYKVREINDYHHAHDAYLNAVVGTALIK KYPKLESEFVYGDYKVYDVRRMIAKSEQEIGKATAKRFFYSNILNFFKTEIKLANGEIRKRPLIETNE ETGEIVWNKEKDFATVRKVLSCPQVNIVKKTEVQTGGFSKESILPKRNSDKLIARKKDWDPKKYG GFDSPTVAYSVLVVAKVEGKSKKLKSVKELLGITIMERSSFEKNPIDFLEAKGYKEVKKDLIIKLP KYSLFELENGRKRMLASAGELQKGNELALPSKYVNFLYLASHYEKLKGSPEDNEQKQLFVEQHKH YLDEIIEQISEFSKRVILADANLDKVLSAYNKHRDKPIREQAENIIHLFTLTNLGAPAAFKYFDTTIDR KRYTSTKEVLDATLIHQSITGLYETRIDLSQLGGD |
| 17 | MKKPYSIGLDIGTNSVGWAVITDDYKVPAKKMKVLGNTNKETIKKNLLGALLFDSGETAEATRLK RTARRRYTRRKNRLRYLQEIFSEEMAKVDDSFFHRLEESFLKDDDKQFDKHPIFGNKAEEKAYHK KFPTIYHLRKHLADSKEKADLRLVYLALAHMIKFRGHFLIEGELKAENTDIQALFKDFVEVYDKTID ESHISEIEVDAISILTEKISKSRRLEKLIQHYSLEKKNTLFGNLIALSLGLQPNFKTNFQLSEDAKLQFS KDTYEEDLEGLLGQVGDEYADLFASAKNLYDAILLSGILTVDDNSTKAPLSASMIKRYKEHKEDLA LFKQFIKSNIPEKYNHIFALGEDEKYNGYTGGNDKKLGHRSGKLVTEEEFYKYLKNILNKVEGADY FLDKIDREDFLRKQRTFDNGSIPHQIHLQEMHAILHRQGEHYPFLKENQDKIEKILTFRIPYYVGPLA RKGSRFAWAEYKTDEKITPWNFEDIIDKEKSAEKFITRMTLNDLYLPEEKVLPKHSLLYEEFAVYNE LTKVRYVTEQGKSFFFDANMKQEIFDGVFKVYRKVTKEKLLDFLDNEFDEFRIVDLTGLDKENKA FNASLGTYHDLKKIIDKDLLDNSSNKTILEDLVLTLTLFEDKKMIKKCLQKYDNLFDDKVLKKLKR RHYTGWGRLSAKLINGIRDKKSGKTILDELTDDGYVNRNFIQLINDGRLTFKKAIEKAQVSGQGDS LTEEVQSLAGSPAIKKGILQSLKIVDELIKVMGYKPENIVIEMARENQTTNQGRRKSQQRLKGLIDSI KEFGSNILKEHPTDNSALQNDRLYLYLQNGKDMYTGDELDIDQLSNYDIDHIIPQAFLKDNSIDNK VLVSSASNRGKSDDVPSLEVVKKRKTFWHQLLKSKLISQRKFDNLTKAERGGLSPEDKAGFIQRQL VETRQITKHVARLLDERFNNKKDEDNKTLRTVKIITLKSSLVSQFRKDFQLYKVREINDFHHAHDA YLNAVVASALLKKYPKLEPEFVYGDYKYNSYKTRKSATEKLFFYSNIMNFFKTEITLANGEIRKRP LIETNEETGEIVWNKCRDFATVRKVLSMPQVNIVKKTEVQTGGFSKESILPKRNSDKLIARKKDWD PKKYGGFDSPTVAYSVLVVAKVEGKSKKLKSVKELLGITIMERSSFEKNPIDFLEAKGYKEVKKD LIIKLPKYSLFELENGRKRMLASAGELQKGNELALPSKYVNFLYLASHYEKLKGSPEDNEQKQLFV EQHKHYLDEIIEQISEFSKRVILADANLDKVLSAYNKHRDKPIREQAENIIHLFTLTNLGAPAAFKYF DTTIDRKRYTSTKEVLDATLIHQSITGLYETRIDLSQLGGD |
| 18 | MKKPYSIGLDIGTNSVGWAVVTDDYKVPAKKMKVLGNTDKSHIKKNLLGALLFDSGNTAEDRRL KRTARRRYTRRRNRILYLQEIFAEEMNKVDESFFHRLDDSFLVPEDKRGSKYPIFATLEEEKEYHKK FPTIYHLRKHLADSKEKTDLRLIYLALAHMIKYRGHFLYEESFDIKNNDIQKIFNEFISIYDNTFEGSS LSGQNAQVEEIFTDKISKSAKRERVLKLFPDEKSTGLFSEFLKLIVGNQADFKKHFDLEEKAPLQFS KDTYDEDLENLLGQIGDDFADLFLVAKKLYDAILLSGILTVTDPSTKAPLSASMIERYENHQKDLA ALKQFIKNNLSEKYDEVFSDQSKDGYAGYIEGKTTQEAFYKYIKKAIEKIEGSDYFLDKIERENFLR KQRTFDNGSIPHQIHLQEMHAIIHRQGEYYPFLKENKEKIEKILTFRIPYYVGPLARGKSDFAWLTRK SDDAIRPWNFEEMVDKESSAEAFIHRMTNYDLYLPEEKVLPKHSLLYEFAVYNELTKVRYVTEQ GKSFFFDANMKQEIFDGIFKKYRKVTKEKLMDFLGKEFDEFRIVDLMGLDKDNKSFNASLGTYHD LKKIVSKDFLDNPENEDILENVVLTLTLFEDREMIRKRLEKYKDVLTEEQRKKLERRHYTGWGRLS AKLINGIRDKVTRKTILDYLIDDGTSNRNFMQLIHDDTLSFVDEIRLAQGSGEAEDYREEVQNLAGS PAIKKGILQSLKIVDELVGVMGYDPEHIVVEMARENQFTNQGRRNSQQRYKKIKDAIKNLDSNLNS KILKEYPTDNQALQNDRLFLYYLQNGKDMYTGEALDINQLSNYDIDHIIPQAFIKDDSLDNRVLTSS KDNRGKSDNVPSIEVVEKMKAFWQQLLDSKLISERKYNNLTKAERERGGLNELDKVGFIKRQLVE TRQITKHVAQILDARFNTEVDEKGKRIRKVKIITLKSNLVSNFRKEFGLYKVREINDYHHAHDAYL NAVVAKAILKKYPKLEPEFVYGDYQKYDIKRYISRSKDPKDIEKATEKYFFYSNLLNFFKEEVHYA DGTIVKRENIEYSKDTGEIAWNKEKDFATVRKVLSCPQVNIVKKTEVQTGGFSKESILPKRNSDKLI ARKKDWDPKKYGGFDSPTVAYSVLVVAKVEGKSKKLKSVKELLGITIMERSSFEKNPIDFLEAK GYKEVKKDLIIKLPKYSLFELENGRKRMLASAGELQKGNELALPSKYVNFLYLASHYEKLKGSPED NEQKQLFVEQHKHYLDEIIEQISEFSKRVILADANLDKVLSAYNKHRDKPIREQAENIIHLFTLTNLG APAAFKYFDTTIDRKRYTSTKEVLDATLIHQSITGLYETRIDLSQLGGD |
| 19 | MKKSYSIGLDIGTNSVGWSVITDDYKVPAKKMKVLGNTDKKYIKKNLLGALLFDSGETAEATRLK RTARRRYTRRKNRLRYLQEIFAKEMAKVDESFFQRLEESFLTDDDKNFDSHPIFGNKAEEEDAYHDE |

| SEQ ID NO | Nuclease Sequence |
|---|---|
| | FPTIYHLRQYLADSPQKADLRLVYLALAHMIKFRGHFLIEGQLNAENTDVQTLFNDFVEVYDKTVE
EESHLSEITVDALSILTEKVSKSRRLENLVKCYPTEKKNTLFGNLIALSLGLQPNFKTNFKLSEDAKLQ
FSKDTYEEDLEELLGKIGDEYADLFASAKNLYDAILLSGILTVDDNTTKAPLSASMVKRYAEHHED
LEKLKEFVKANKPELYHDIFKDETKNGYAGYIENGVKQDEFYKYLKNTLSKIAGSDYFLDKIERED
FLRKQRTFDNGSIPHQIHLQEMHAILRRQGEYYPFLKENQAKIEKILTFRIPYYVGPLARKNSRFAW
AEYHSDEKITPWNFEEIVDKEESATAFIHRMTNNDLYLPEEKVLPKHSLIYEEFTVYNELTKVKYVT
DQGKAYYFDANMKQEIFDGVFKEHRKVTKDKLMNFLEKEFDEFRIVDLTGLDKENKSFNASLGTY
HDLKKILDKSFLDDKTNETIIEDIIQTLTLFEDRDMIRQRLQKYSDIFTPQQLKKLERRHYTGWGRLS
YKLINGIRNKENGKTILDYLIDDGYANRNFMQLINDDTLPFKQIIQEAQIIGDIDDIETVVHDLPGSPA
IKKGILQSVKIVDELVKVMGHNPDNIVIEMARENQTTNRGRSQSQQRLKKLQESLKELGSNILNEEK
PSYVEDKVENSHLQNDKLFYYIQNGKDMYTGEELDIDHLSDYDIDHIIPQAFIKDNSIDNRVLTSS
AKNRGKSDDVPSLDIVHDRKADWIRLYKSGLISKRKFDNLTKAEHGGLTEDDKAGFIKRQLVETR
QITKHVAQILDSRENTERDENDKVIRDVKVITLKSNLVSQFRKDFELHKVREINDYHHAHDAYLNA
VIGNALLVKYPQLEPEFVYGKFKHFHGHKENKATAKKFFYSNIMALFKKDVEYSDDTGEMVWNK
EKDFATVRKVLSCPQVNIVKKTEVQTGGFSKESILPKGNSDKLIPRKTKKFYWDTKKYGGFDSPIV
AYSVLVIADIEKGKAKKLKTVKALVGVTIMEKMTFERDPVAFLERKGYRNVQEENIIKLPKYSLFK
LENGRKRLLASARELQKGNEIVLPNHLGTLLYHAKNIHKVDEPKHLDYVDKHKDEFKELLDVVSN
FSKKYTLAEGNLEKIKELYAQNNGEDLKELASSFINLLTFTAIGAPATFKFFDKNIDRKYTSTTEIL
NATLIHQSITGLYETRIDLSKLGGD |
| 20 | MGKPYSIGLDIGTNSVGWAVITDDYKVPAKKMKVLGNTDKKYIKKNLLGALLFDSGETAEATRLK
RTARRRYTRRKNRLRYLQEIFAEEMAKVDSTFFRRLNESFLTDDDKQFNACPIFGNLAEEDAYHEK
FPTIYHLRKYLADNPDKADLRLIYLALAHMIKFRGHFLIEGELNSENTDIQKVFEEFVEIFERDVKSE
LSESKLEIASVLLEKTAKARRLESVLAQFPNEKRTGLFAEFLKLIVGNQADFKKHFDLEEKAPLQFS
KDTYDEDLENLLGQIGDGFAELFLVAKKLYDAILLSGILTVTDPSTKAPLSASMIERYESHQKDLAA
LKQFVRRNLPEKYDEVFSDQSKDGYAGYIDGKTTQEAFYKYIKKLIEKIDGKGYFLAKIKQEDLLR
KQRTFDNGSIPHQIHLGELHAIIRRQEDFYPPLKENRKKIEKLLTFRIPYYVGPLARGNNDPAWLTRN
SDQAIRPWNFEEIVDKASSAEDFIHKMTNYDLYLPEEKVLPKHSLLYETFTVYNELTKVKFIAEGLR
DYQFLDSGQKQIVNQLFKEKRKVTEKDIIHYLHTVDGYDGIELKGIEKQFNSSLSTYHDLLKIIKD
KEFMDDAKNEVILENIVHTLTIFEDREMIKQRLAQYSSIFDEKVIKALTRRHYTGWGKLSAKLINGI
CDKKTGKTILDYLIDDGYTNRNFMQLINDDSLSFKEIIEKAQVSGKGDSVHEQIANLAGSPAIKKGIL
QSIKIVDELVKVMGHKPENIVIEMARENQTTAKGKKNSQQRYKRIEEGLENLAKELGSQILKEHPA
DNIQLQNDRLYLYYLQNGKDMYTGEALDINRLSDYDIDHIVPQAFIKDNSIDNKVLTYSKENRGKS
DNVPSEDVVKKMKNYWRQLLNAKLITQRKFDNLTKAERGGLSELDKAGFIKRQLVETRQITKHVA
QILDSRMNAKYDENDKLIRDVKIITLKSKLVSDFRKDFQFYKVREINNYHHAHDAYLNAVVGTALI
KKYPKLESEFVYGDYKVYDVRKMIAKSEQEIGKATAKQFFYSNIMNFFKTEITLANGEIRKRPVIET
NEETGEIVWDKGRDFATVRKVLCMPQVNIVKKTEVQTGGFSKESILPKRNSDKLIARKKDWDPKK
YGGFDSPTVAYSVLVVAKVEKGKSKKLKSVKELLGITIMERSSFEKNPIDFLEAKGYKEVKKDLIIK
LPKYSLFELENGRKRMLASAGELQKGNELALPSKYVNFLYLASHYEKLKGSPEDNEQKQLFVEQH
KHYLDEIIEQISEFSKRVILADANLDKVLSAYNKHRDKPIREQAENIIHLFTLTNLGAPAAFKYFDTTI
DRKRYTSTKEVLDATLIHQSITGLYETRIDLSQLGGD |
| 21 | MKKSYSIGLDIGTNSVGWSVVTDDYKVPAKKMKVFGNTDKKYIKKNLLGALLFDSGETAEGTRL
KRTARRRYTRRRNRILYLQEIFAKEMAKVDESFFQRLEESFLTDDDKNFDSHPIFGNKAEEDAYHE
QFPTIYHLRKHLADSSEKADLRLVYLALAHMIKFRGHFLIEGQLKAENTNVQTLFNDFVEVYDKTV
EESHLAEITVDALSILTEKVSKSRRLENLLKYYPTEKKNTLFGNLIALSLGLQPNFKTNFKLSEDAKL
QFSKDTYEEDLEELLGKIGDEYADLFTSAKNLYDAILLSGILTVDDKSTKAPLSASMLKRYVEHHE
DLEKLKDFVKANKPELYHDIFKDETKNGYAGYIENGVKQDEFYKYLKNTLSKIAGSDYFLDKIERE
DFLRKQRTFDNGSIPHQVHLQEMRAILRRQGEYYPFLKENQAKIEKILTFRIPYYVGPLARKDSRFA
WAEYHSDEKITPWNFDKVIDKESSARAFIEHMTNNDLYLPEEKVLPKHSPLYEKYTVYNELTKVK
YVTEQGKSSFFDANMKQEIFEHVFKKNRKVTKDKFLNYLNKEFPEYRIHDLIGLDKENKSFNASLG
TYHDLKKILDKSFLDNKENEEIIEDVVLTLTLFEDRDMIRQRLQKYSDIFTKDQLKKLERRHYTGW
GRLSYKLINGIRDKQSNKTILDYLLEDDGVKKNINRNFMQLINDDSLSFKTIIQEAQVIGDIDDIKAV
VHDLPGSPAIKKGILQSVKIVDELVKVMGHNPDNIVIEMARENQTTNRGRSQSQQRLKKLQESLKE
LGSNILNEEKPSYIEDKVENSHLQNDRLFYYIQNGKDMYTGDELDIDHLSDYDIDHIIPQAFIKDNS
IDNRVLTSSAKNRGKSDDVPSLDIVRERKADWIRLYKAGLISKRKFDNLTKAERGGLTENDKAGFI
KRQLVETRQITKHVAQILDARFNTKRDENDKVIRDVKIITLKSNLVSQFRKEFGFYKVREINDYHHA
HDAYLNAVVGTALIKKYPKLESEFVYGDYKVYDVRKMIAKSEQEIGKATAKRFFYSNIMNFFKTEI
KLANGEIRKRPLIETNEETGEVVWNKERDFAIVRKVLSCPQVNIVKKTEVQTGGFSKESILPKGNSD
KLIARKKDWDPKKYGGFDSPIVAYSVLVVAKVAKGKSQKIKTIKELVGIKIMEQDEFEKDPIAFLEK
KGYQDIQKDLIIKLPKYSLFELENGRKRLLASAGELQKGNELALPSKYVNFLYLASHYEKLKGSPE
DNEQKQLFVEQHQHYLDEIIEQISEFSKRVILADANLDKVLSAYNKHRDKPIREQAENIIHLFTLTNL
GAPAAFKYFDTTIDRKRYTSTKEVLDATLIHQSITGLYETRIDLSQLGGD |
| 22 | MKKSYSIGLDIGTNSVGWSVVTDDYKVPAKKMKVFGNTDKKYIKKNLLGALLFDSGETAEGTRL
KRTARRRYTRRRNRILYLQEIFAKEMAKVDESFFQRLEESFLTDDDKNFDSHPIFGNKAEEDAYHE
QFPTIYHLRKHLADSSEKADLRLVYLALAHMIKFRGHFLIEGQLKAENTNVQTLFNDFVEVYDKTV
EESHLAEITVDALSILTEKVSKSRRLENLLKYYPTEKKNTLFGNLIALSLGLQPNFKTNFKLSEDAKL
QFSKDTYEEDLEELLGKIGDEYADLFTSAKNLYDAILLSGILTVDDKSTKAPLSASMLKRYVEHHE
DLEKLKDFVKANKPELYHDIFKDETKNGYAGYIENGVKQDEFYKYLKNTLSKIAGSDYFLDKIERE
DFLRKQRTFDNGSIPHQVHLQEMRAILRRQGEYYPFLKENQAKIEKILTFRIPYYVGPLARKDSRFA
WAEYHSDEKITPWNFDKVIDKESSARAFIEHMTNNDLYLPEEKVLPKHSPLYEKYTVYNELTKVK
YVTEQGKSSFFDANMKQEIFEHVFKKNRKVTKDKFLNYLNKEFPEYRIHDLIGLDKENKSFNASLG
TYHDLKKILDKSFLDNKENEEIIEDVVLTLTLFEDRDMIRQRLQKYSDIFTKDQLKKLERRHYTGW |

| SEQ ID NO | Nuclease Sequence |
|---|---|
| | GRLSYKLINGIRDKQSNKTILDYLLEDDGVKKNINRNFMQLINDDSLSFKTIIQEAQVIGDIDDIKAV
VHDLPGSPAIKKGILQSVKIVDELVKVMGHNPDNIVIEMARENQTTNRGRSQSQQRLKKLQESLKE
LGSNILNEEKPSYIEDKVENSHLQNDRLFYYIQNGKDMYTGDELDIDHLSDYDIDHIIPQAFIKDNS
IDNRVLTSSAKNRGKSDDVPSLDIVRERKADWIRLYKAGLISKRKFDNLTKAERGGLTENDKAGFI
KRQLVETRQITKHVAQILDARFNTKRDENDKVIRDVKIITLKSNLVSQFRKEFGFYKVREINDYHHA
HDAYLNAVVGTALIKKYPKLESEFVYGDYKVYDVRKMIAKSEQEIGKATAKRFFYSNIMNFFKTEI
KLANGEIRKRPLIETNEETGEVVWNKERDFAIVRKVLSCPQVNIVKKTEVQTGALTNESIYARGSFD
KLISRKHRFESSKYGGFGSPTVTYSVLVVAKSKVQDGKVKKIKTGKELIGITLLDKLVFEKNPLKFIE
DKGYGNVQIDKCIKLPKYSLFEFENGTRRMLASVMANNNSRGDLQKANEMFLPAKLVTLLYHAH
KIESSKELEHEAYILDHYNDLYQLLSYIERFASLYVDVEKNISKVKELFSNIESYSISEICSSVINLLTL
TASGAPADFKFLGTTIPRKRYGSPQSILSSTLIHQSITGLYETRIDLSQLGGD |
| 23 | MTKPYSIGLDIGTNSVGWAVITDSYKVPSKKMKVLGNTSKKYVKKNLLGALLFESGITAEGRRLK
RTARRRYTRRRNRILYLQEIFAAEMNKIDESFFQRLDDSFLVPDDKRDSKYPIFGNLAEEKAYHEKF
PTIYHLRKYLADSSEKADLRLVYLALAHMIKYRGHFLIEGDFNSRNNDIKKNFQDFLDSYNAIFESD
LSLENSKQLEEIVKDKISKSAKRERVLKLFPDEKSTGLFSEFLKLIVGNQAEFKKHFDLEEKAPLQFS
KDTYDEDLENLLGQIGDDFADLFLVAKKLYDAILLSGILTVTDPSTKAPLSASMIERYENHQKDLA
ALKQFIQNNLQEKYDEVFSDQSKDGYAGYIDKTTQEAFYKYIKNILSKLEGSDYFLDKIEREDFLR
KQRTFDNGSIPHQIHLQEMNAILRRQGEHYPFLKENKEKIQQILTFRIPYYVGPLARGNRDFAWLTR
NSDQAIRPWNFEEIVDQASSAEEFINKMTNYDLYLPEEKVLPKHSLLYETFAVYNELTKVKFIAEGL
RDYQFLDSGQKKQIVNQLFKEKRKVTEKDIIHYLHNVDGYDLGIELKGIEKQFNASLSTYHDLLKII
DKEFMDDPKNEEILENIVHTLTIFEDREMIKQRLAQYDSLFDEKVIKALARRHYTGWGRLSAKLID
GIYDKQSRKTILDYLIDDGEINRNFMQLINDDGLSFKEIIQKAQVVGKTDDVKQVVQELPGSPAIKK
GILQSIKIVDELVKVMGHAPESIVIEMARENQTTARGKKNSQQRYKRIEDALKNLAPGLDSNILKEN
PTDNIQLQNDRLFYYLQNGKDMYTDEELDINQLSNYDIDHIIPQAFIKDDSLDNRVLTSSKDNRGK
SDNVPSLEVVQKRKAFWQQLLDSKLISERKENNLTKAERGGLDERDKVGFIKRQLVETRQITKHVA
QILDARFNTEVDENNQRIRKVKIVTLKSNLVSNFRKEFGLYKVREINDYHHAHDAYLNAVVAKAIL
KKYPKLEPEFVYGDYQKYDVKRYISRSKDPKEIEKATQKYFFYSNLLNFFKEEVHYADGTIIKRENI
EYSKDTGEIAWNKEKDFATVRKVLSCPQVNIVKKTEVQTGGFSKESILPKRNSDKLIARKKDWPIF
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 24 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKVYHDEF
PTIYHLRKYLADSSKKADLRLVYLALAHMIKYRGHFLIEGDFNSRNNDIKKNFQNFLDSYNAIFESD
LSLENSKQLEEIVKDKISKSAKRERVLKLFPDEKSTGLFSEFLKLIVGNQAFKKHFDLEEKAPLQFS
KDTYDEDLENLLGQIGDDFADLFLVAKKLYDAILLSGILTVTDPSTKAPLSASMIERYENHQKDLA
ALKQFIQNNLQEKYDEVFSDQSKDGYAGYIDKTTQEAFYKYIKNLLSKLEGADYFLDKIEREDFL
RKQRTFDNGSIPHQIHLQEMNAILRRQGEHYPFLKENKEKIQQILTFRIPYYVGPLARGNRDFAWLT
RNSDQAIRPWNFEEIVDKASSAEDFINKMTNYDLYLPEEKVLPKHSLLYETFAVYNELTKVKFIAEG
LRDYQFLDSGQKKQIVNQLFKEKRKVTEKDIIQFLHNVDGYDGIELKGIEKQFNASLSTYHDLLKII
KDKEFMDDAKNEEILENIVHTLTIFEDREMIKQRLAQYDSLFDEKVIKALARRHYTGWGKLSAKLI
NGIRDKQSQKTILDYLIDDGEINRNFMQLIHDDGLSFKDIIQKAQVVGDTDDLKQVVQNLPGSPAIK
KGILQSIKIVDELVKVMGGDPESIVVEMARENQFTNQGKRNSQQRYKRIEDAIKNLDSNLNSKILKE
YPTDNQALQNDRLFLYYLQNGKDMYTGEALDINQLSNYDIDHIIPQAFIKDDSLDNRVLTSSKDNR
GKSDNVPSIEVVKARKAFWQQLLDSKLISERKFNNLTKAERGGLNELDKVGFIKRQLVETRQITKH
VAQILDARFNTEVNEENQKIRTVKIITLKSNLVSNFRKEFGLYKVREINDYHHAHDAYLNAVVAKA
ILKKYPKLEPEFVYGDYKRYDLQKLRAKSEKEMGKATAKKFFYSNLMNFFKEVRLADGTVIVRP
VIEYSKDTGEIAWNKEKDFATVRKVLSCPQVNIVKKTEVQTGGFSKESILPKRNSDKLIARKKDWD
PKKYGGFDSPTVAYSVLVVAKVEKGKSKKLKSVKELLGITIMERSSFEKNPIDFLEAKGYKEVRKD
LIVKLPKYSLFELENGRKRMLASAGELQKGNELALPSKYVNFLYLASHYEKLKGSPEDNEQKQLFV
EQHKHYLDEIIEQISEFSKRVILADANLDKVLSAYNKHRDKPIREQAENIIHLFTLTNLGAPAAFKYF
DTTIDRKRYTSTKEVLDATFIHQSITGLYETRIDLSQLGGD |
| 25 | MTKPYSIGLDIGTNSVGWAVITDNYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKVYHDEF
PTIYHLRKYLADSSKKADLRLVYLALAHMIKYRGHFLIEGDFNSRNNDIKKNFQNFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLA
ALKQFIQNNLQEKYDEVFSDQSKDGYAGYIDKTTQEAFYKYIKNLLSKLEGADYFLEKIEREDFL
RKQRTFDNGSIPHQIHLQEMNAILHNQGEYYPFLKENSEKILQTFRIPYYVGPLARGNRDFAWLT
RNSDQAIRPWNFEEIVDKASSAEDFINKMTNYDLYLPEEKVLPKHSLLYETFAVYNELTKVKFIAEG
LRDYQFLDSGQKKQIVNQLFKEKRKVTEKDIIQFLHNVDGYDGIELKGIEKQFNASLSTYHDLLKII
KDKEFMDDPKNEEILENIIHTLTIFEDREMIKQRLAQYDSIFDEKVIKALTRRHYTGWGKLSAKLIN
GIRDKKSGKTILDYLIDDDKINRNFMQLIHDDGLSFKEIIQKAQVVGKTDDVKQVVQELPGSPAIKK
GILQSIKIVDELVKVMGHAPESIVIEMARENQTTNQGKRNSQQRYKRIEEAIKNLAPELDGNILKEY
PTDNQALQNDRLFLYYLQNGKDMYTGEELDINQLSNYDIDHIIPQAFIKDDSIDNRVLTSSKDNRG
KSDNVPSLEVVQKRKAFWQQLLDSKLISERKENNLTKAERGGLDERDKVGFIRRQLVETRQITKHV
AQILDARFNTEVNEKNQKIRSVKIITLKSNLVSNFRKEFELYKVREINDYHHAHDAYLNAVVAKAIL
KKYPKLEPEFVYGDYQKYDIKRYISRSKDPKDIEKATEKYFFYSNLLNFFKEEVHYADGTIIKRENIE
YSKDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI |

| SEQ ID NO | Nuclease Sequence |
|---|---|
| | VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 26 | MTKPYSIGLDIGTNSVGWAVITDDYKVPSKKMKVLGNTSKKYVKKNLLGALLFESGITAEGRRLK<br>RTARRRYTRRRNRILYLQEIFSTEMNKIDESFFQRLDDSFLVPDDKRDSKYPIFGNLAQEKTYHDEF<br>PTIYHLRKYLADSSKKADLRLVYLALAHMIKYRGHFLIEGDFNSKSNSIKETFSKFLDSYNAIFESDL<br>SLENSKQLEEIVKDKISKSAKRERVLKLFPDEKSTGLFSEFLKLIVGNQADFKKHFDLEEKAPLQFSK<br>DTYDEDLENLLGQIGDGFADLFLVAKKLYDAILLSGILTVTDPSTKAPLSASMIERYENHQKDLATL<br>KQFIKNNLSEKYDEVFSDQSKDGYAGYIDGKTTQEAFYKYIKNLLSKLEGADYFLDKIEREDFLRK<br>QRTFDNGSIPHQIHLQEMNAILRRQGEHYPFLKENREKIEKILTFRIPYYVGPLARGNRDFAWLTRN<br>SDQAIRPWNFEEIVDQASSAEDFINKMTNYDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLSTYHDLLKIIKD<br>KEFMDDPKNEEILENIVHTLTIFEDREMIKQRLAQYDSLFDEKVIKALTRRHYTGWGKLSAKLINGI<br>RDKKSGKTILDYLIDDGEINRNFMQLIHDDGLSFKEIIQKAQVFGKTDDVKQVVQNLPGSPAIKKGI<br>LQSIKIVDELVKVMGKDPESIVIEMARENQTTNQGRRNSQQRYKKIEEAIKKLDIDLNSKILKEYPT<br>NNQALQNERLFLYYLQNGKDMYTDQELDINRLSDYDIDHIVPQAFIKDDSLDNRVLTSSKDNRGKS<br>DNVPSEEVVQKMKGFWQQLLKSKLISKRKFDNLTKAERGGLTEKDKAGFIKRQLVETRQITKHVA<br>QILDARFNTEVNEKNQKIRKVKIVTLKSNLVSNFRKEFGLYKVREINDYHHAHDAYLNAVVAKAIL<br>KKYPKLEPEFVYGDYQKYDIKRYISRSKDPKDIEKATEKYFFYSNLLNFFKEEVHYADGTIIKRENIE<br>YSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 27 | MTKPYSIGLDIGTNSVGWAVITDSYKVPSKKMKVLGNTSKKYVKKNLLGALLFESGITAEGRRLK<br>RTARRRYTRRRNRILYLQEIFSTEMSKIDESFFQRLDDSFLVPDDKRDSKYPIFGNLVKEKTYHDEFP<br>TIYHLRKYLADSSKKADLRLVYLALAHMIKYRGHFLIEGDFNSRNNDIKKNFQNFLDSYNAIFESDL<br>SLENSKQLEEIVKDKISKSAKRERVLKLFPDEKSTGLFSEFLKLIVGNQADFKKHFDLEEKAPLQFSK<br>DTYDEDLENLLGQIGDGFADLFLVAKKLYDAILLSGILTVTDPSTKAPLSASMIERYENHQKDLAAL<br>KQFIKTNLPEKYDEVFSDQSKDGYAGYIDGKTTQEAFYKYIKNTLSKIEGSDYFLDKIEREDFLRKQ<br>RTFDNGSIPHQIHLQEMNAIIRRQGEHYPFLKENKEKIEKILTFRIPYYVGPLARGNRDFAWLTRNSD<br>QAIRPWNFEEIVDQASSAEDFINKMTNYDLYLPEEKVLPKHSLLYETFAVYNELTKVKFIAEGLRD<br>YQFLDSGQKKQIVNQLFKEKRKVTEKDIIQFLHNVDGYDGIELKGIEKQFNASLSTYHDLLKIIKDK<br>EFMDDPKNQEILENIVHTLTIFEDREMIKQRLAQYDSIFDEKVIKALTRRHYTGWGKLSAKLINGIC<br>DKKTGKTILDYLIDDGEINRNFMQLIHDDGLSFKEIIQKAQVFGKTDDVKQVVQELPGSPAIKKGIL<br>QSIKIVDELVKVMGHAPESIVIEMARENQTTNQGRRNSQQRYKKIKEAIKNLDSNLNSKILKEYPTD<br>NQALQNDRLFLYYLQNGKDMYTGEPLDINQLSSYDIDHIIPQAFIKDDSLDNRVLTSSKDNRGKSD<br>NVPSLEIVEKMKGFWQQLLNSKLISERKFNNLTKAERGGLDERDKVGFIKRQLVETRQITKHVAQI<br>LDARFNTEVNDKNQKIRTVKIITLKSNLVSNFRKEFGLYKVREINDYHHAHDAYLNAVVAKAILKK<br>YPKLEPEFVYGDYQKYDLKRYISKSKNPKELDKATQKYFFYSNLLNFFKEEVHYADGTIIKRENIEY<br>SKDTGEIAWNKEKDFATVRKVLSCPQVNIVKKTEVQTGGFSKESILPKRNSDKLIARKKDWDPKK<br>YGGFDSPTVAYSVLVVAKVEKGKSKKLKSVKELLGITIMERSSFEKNPIDFLEAKGYKEVRKDLIV<br>KLPKYSLFELENGRKRMLASAGELQKGNELALPSKYVNFLYLASHYEKLKGSPEDNEQKQLFVEQ<br>HKHYLDEIIEQISEFSKRVILADANLDKVLSAYNKHRDKPIREQAENIIHLFTLTNLGAPAAFKYFDT<br>TIDRKRYTSTKEVLDATFIHQSITGLYETRIDLSQLGGD |
| 28 | MTKPYSIGLDIGTNSVGWAVITDSYKVPSKKMKVLGNTSKKYVKKNLLGALLFESGITAEGRRLK<br>RTARRRYTRRRNRILYLQEIFDTEMKEIDESFFQRLDDSFLVPDDKRDSKYPIFGNLAQEKTYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIKNNLSEKYDEVFSDESKDGYAGYINGKTTQEAFYKYIKNLLSKLEGADYFLDKIEREDFL<br>RKQRTFDNGSIPHQIHLQEMNAIIRRQGEHYPFLQENKEKIEKILTFRIPYYVGPLARGNRDFAWLTR<br>NSDQAIRPWNFEEIVDKASSAEDFINKMTNYDLYLPEEKVLPKHSLLYETFAVYNELTKVKFIAEGL<br>RDYQFLDSGQKKQIVNQLFKEKRKVTEKDIIQFLHNVDGYDGIELKGIEKQFNASLSTYHDLLKIIK<br>DKEFMDDPKNEEILENIVHTLTIFEDREMIKQRLAQYDSLFDEKVIKALTRRHYTGWGKLSAKLING<br>IYDKQSQKTILDYLIDDDKINRNFMQLINDDGLSFKEIIQKAQVVGKTDDVKQVVQELPGSPAIKKG<br>ILQSIKIVDELVKVMGHAPESIVIEMARENQTTARGRKNSQQRYKKIMDAIKNLDSNLNSKILKEYP<br>TDNQALQNDRLFLYYLQNGKDMYTGEPLDINQLSSYDIDHIIPQAFIKDDSLDNRVLTSSKDNRGK<br>SDNVPSIEVVKKMKGFWQQLLDSKLISERKENNLTKAERGGLDERDKVGFIRRQLVETRQITKHVA<br>QILDARFNTEVDEKGKRIRKVKIITLKSNLVSNFRKEFGLYKVREINDYHHAHDAYLNAVVAKAIL<br>KKYPKLEPEFVYGDYQKYDVKRYISRSKDPKEVEKATEKYFFYSNLLNFFKEEVHYADGTIVKRE<br>NIEYSKDTGEIAWNKEKDFATVRKVLSCPQVNIVKKTEVQTGGFSKESILPKRNSDKLIARKKDWD<br>PKKYGGFDSPTVAYSVLVVAKVEKGKSKKLKSVKELLGITIMERSSFEKNPIDFLEAKGYKEVRKD<br>LIVKLPKYSLFELENGRKRMLASAGELQKGNELALPSKYVNFLYLASHYEKLKGSPEDNEQKQLFV<br>EQHKHYLDEIIEQISEFSKRVILADANLDKVLSAYNKHRDKPIREQAENIIHLFTLTNLGAPAAFKYF<br>DTTIDRKRYTSTKEVLDATFIHQSITGLYETRIDLSQLGGD |
| 29 | MKKPYSIGLDIGTNSVGWAVVDDDYKVPAKKMRVFGDTDRSHIKKNLLGTLLFDDGNTAESRRL<br>KRTARRRYTRRRNRILYLQEIFAEEMNKVDESFFHRLDDSFLVPEDKRGSKYPIFATLEEEKEYHKK<br>FPTIYHLRKHLADSKEKTDLRLIYLALAHMIKYRGHFLYEESFDIKNNDIQKIFNEFISLYDNTFEGSS<br>LSGQNAQVEAIFTDKISKSAKRERVLKLFPDEKSTGLFSEFLKLIVGNQADFKKHFDLEEKAPLQFS |

| SEQ ID NO | Nuclease Sequence |
|---|---|
|  | KDTYDEDLENLLGQIGDDFADLFLVAKKLYDAILLSGILTVTDPSTKAPLSASMIERYENHEEDLAA<br>LKQFVKANLPEKYDEVFSDQSKDGYAGYIDGKTTQEAFYKYIKNLLSKLEGADYFLDKIEREDFLR<br>KQRTFDNGSIPHQIHLQEMNAILRRQGEHYPFLKDNKEKIEKILTFRIPYYVGPLARGNRDFAWLTR<br>NSDQAIRPWNFEEVVDKASSAEDFINKMTNYDLYLPEEKVLPKHSLLYETFAVYNELTKVKFIAEG<br>LRDYQFLDSGQKKQIVNQLFKTKRKVTEKDIINYLHKVDGYDGVEISGVEDRFNASLGTYHDLLKI<br>IKDKSFLDDKKNEEIIEDIVLTLTLFEDRDMIRQRLQKYSDIFTPQQLKKLERRHYTGWGRLSYKLIN<br>GIRNKENNKSILDYLIDDGYANRNFMQLINDDTLPFKQIIQKSQVVGDIDDIKTVVHDLPGSPAIKK<br>GILQSVKIVDELVKVMGHNPDNIVIEMARENQTTNRGRSQSQQRLKKLQESLKELGSNILNVEKPS<br>YIEDKVENNHLQNDKLFLYYIQNGKDMYTGEELDIDHLSDYDIDHIIPQAFIKDDSIDNRVLTSSAK<br>NRGKSDDVPSLDIVRGRKAEWIRLYKAKLISQRKFDNLTKAERGGLTENDKAGFIKRQLVETRQIT<br>KHVAQILDARFNTKRDENDKLIREVKVITLKSNLVSQFRKEFGFYKVREINDYHHAHDAYLNAVV<br>GTAILKKYPKLTSEFVYGEYKKYDIRKFIKSDDHSEMGKATAKYFFYSNLLNFFKEEIKYANGKIVV<br>RPVVEYSKDTGEIAWNKEKDFATVRKVLSCPQVNIVKKTEVQTGGFSKESILPKRNSDKLIARKKD<br>WDPKKYGGFDSPTVAYSVLVVAKVEKGKSKKLKSVKELLGITIMERSSFEKNPIDFLEAKGYKEVR<br>KDLIVKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDATFIHQSITGLYETRIDLSQLGGD |
| 30 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKADLRLVYLALAHMIKYRGHFLIEGDFNSRNNDIKKNFQNFLDSYNAIFESDL<br>SLENSEQVEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLATL<br>KQFVKANLPEKYDEVFSDQSKDGYAGYIDGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDQASSAEEFINKMTNYDLYLPEEKVLPKHSLLYETFAVYNELTKVKFIAEGLR<br>DYQFLDSGQKKQIVNQLFKEKRKVTEKDIIHYLHTVDGYDGIELKGIEKQFNASLSTYHDLLKIIKD<br>KEFMDDPKNEEILENIVHTLTIFEDREMIKQRLAQYDSLFDEKVIKALTRRHYTGWGKLSAKLINGI<br>YDKQSQKTILDYLIDDDKINRNFMQLIHDDGLSFKEIIQKAQVFQDTDDVKQVVQELPGSPAIKKGI<br>LQSIKIVDELVKVMGHAPESIVIEMARENQTTARGRKNSQQRYKKIMDAIKNLDSNLNSKILKEYPT<br>DNQALQNDRLFLYYLQNGKDMYTGEPLDINQLSSYDIDHIIPQAFIKDDSLDNRVLTSSKDNRGKS<br>DNVPSLEIVEKMKGFWQQLLDSKLISERKENNLTKAERGGLDERDKVGFIKRQLVETRQITKHVAQ<br>ILDARFNTEVNEKKQKIRTVKIITLKSNLVSNFRKEFRLYKVREINDYHHAHDAYLNAVVAKAILK<br>KYPKLEPEFVYGDYQKYDLKRYISKSKNPKSIDKATQKYFFYSNLLNFFKEEVHYADGTIIKRENIE<br>YSKDTGEIAWNKEKDFATVRKVLSCPQVNIVKKTEVQTGGFSKESILPKRNSDKLIARKKDDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 31 | MTKPYSIGLDIGTNSVGWAVITDNYKVPSKKMKVLGNTSKKYVKKNLLGALLFESGITAEGRRLK<br>RTARRRYTRRRNRILYLQEIFSTEMSKVDESFFQRLDDSFLVPDDKRDSKYPIFGNLVEEKTYHDEF<br>PTIYHLRKYLADSTKKADLRLVYLALAHMIKYRGHFLIEGDFNSRNNDIKKNFQDFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIQNNLQEKYDEVFSDQSKDGYAGYINGKTTQEAFYKYIKNLLSKLKGADYFLEKIEREDFL<br>RKQRTFDNGSIPHQIHLQEMNAILRRQGEHYPFLKENREKIEKILTFRIPYYVGPLARGNRDFAWLT<br>RNSDQAIRPWNFEEVVDQASSAEDFINKMTNYDLYLPEEKVLPKHSLLYETFAVYNELTKVKFIAE<br>GLRDYQFLDSGQKKQIVTQLFKEKRKVTEKDIIQFLHNVDGYDGIELKGIEKQFNASLSTYHDILKII<br>KDKEFMDDPKNGEILENIIHTLTIFEDREMIKQRLAQYDSIFDEKVIKALARRHYTGWGKLSAKLIN<br>GIRDKQTNKTILDYLIDDDKINRNFMQLINDDGLSFKDIIQKAQVVGKTDDVKQVVQELPGSPAIKK<br>GILQSIKIVDELVKVMGHAPESIVIEMARENQTTNQGKRNSQQRYKRIEEAIKNLDSNLNSKILKEYP<br>TDNQALQNDRLFLYYLQNGKDMYTGEELDINQLSNYDIDHIIPQAFIKDDSLDNRVLTSSKDNRGK<br>SDNVPSLEVVQRKGFWQQLLNSKLISERKENNLTKAERGGLDERDKVGFIKRQLVETRQITKHVA<br>QILDARFNTEVDENGKRIRKVKIITLKSNLVSNFRKEFGLYKVREINDYHHAHDAYLNAVVAKAIL<br>KKYPKLEPEFVYGDYQKYDIKRYISKSRNPRSVDKATQKYFFYSNLLNFFKEEVHYADGTIIKRENI<br>EYSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 32 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQNFLDSYNAIFESDL<br>SLENSEQEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLAAL<br>KQFIQNNLQEKYDEVFSDQSKDGYAGYIDGKTTQEAFYKYIKNLLSKFEGADYFLEKIEREDFLRK<br>QRTFDNGSIPHQVHLQEMNAILRHQGEYYPFLQEENKEKIQQILTFRIPYYVGPLARGNRDFAWLTR<br>NSDQAIRPWNFEEVVDQASSAEDFINKMTNYDLYLPEEKVLPKHSLLYETFAVYNELTKVKFIAEG<br>LRDYQFLDSGQKKQIVTQLFKEKRKVTEKDIIQFLHNVDGYDGIELKGIEKQFNASLSTYHDLLKII<br>KDKEFMDDPKNEEILENIVHTLTIFEDREMIKQRLAQYDSLFDEKVIKALTRRHYTGWGKLSAKLIN<br>GIYDKQSKKTILDYLIDDDKINRNFMQLINDDGLSFKEIIQKAQVVGKTDDVKQVVQELPGSPAIKK<br>GILQSIKIVDELVKVMGHAPESIVIEMARENQTTNQGKRNSQQRYKRIEDAVKNLASELDGNILKEY |

| SEQ ID NO | Nuclease Sequence |
|---|---|
| | PTDNQALQNDRLFLYYLQNGKDMYTGEPLDINQLSSYDIDHIVPQAFIKDDSLDNRVLTSSKDNRG
KSDNVPSLEVVQKRKAFWQQLLDSKLISERKENNLTKAERGGLDERDKVGFIKRQLVETRQITKHV
AQILDARFNTEVNEKGQKIRKVKIITLKSNLVSNFRKEFGLYKVREINDYHHAHDAYLNAVVAKAI
LKKYPKLEPEFVYGDYQKYDIKRYISRSKDPKDVEKATQKYFFYSNLLNFFKEEVHYADGTIVKRE
NIEYSKDTGEIAWNKEKDFATVRKVLSCPQVNIVKKTEVQTGGFSKESILPKRNSDKLIARKKDWD
PKKYGGFDSPTVAYSLVVVAKVEKGKSKKLKSVKELLGITIMERSSFEKNPIDFLEAKGYKEVRKD
LIVKLPKYSLFELENGRKRMLASAGELQKGNELALPSKYVNFLYLASHYEKLKGSPEDNEQKQLFV
EQHKHYLDEIIEQISEFSKRVILADANLDKVLSAYNKHRDKPIREQAENIIHLFTLTNLGAPAAFKYF
DTTIDRKRYTSTKEVLDATFIHQSITGLYETRIDLSQLGGD |
| 33 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKTYHDEFP
TIYHLRKYLADSSKKADLRLVYLALAHMIKYRGHFLIEGDFNSRNNDIKKNFQDFLDSYNAIFESDL
SLENSKQLEEIVKDKISKSAKRERVLKLFPDEKSTGLFSEFLKLIVGNQADFKKHFDLEEKAPLQFSK
DTYDEDLENLLGQIGDDFADLFLVAKKLYDAILLSGILTVTDPSTKAPLSASMIERYENHQKDLAAL
KQFIKSNLSEKYDEVFSDESKNGYAGYIENGVKQDEFYKYLKNTLSKIEGSDYFLDKIEREDFLRKQ
RTFDNGSIPHQIHLQEMNAIIRRQGEHYPFLKENKEKIEKILTFRIPYYVGPLARGNRDFAWLTRNSD
QAIRPWNFEEVVDKASSAEEFINKMTNYDLYLPEEKVLPKHSLLYETFAVYNELTKVKFIAEGLRD
YQFLDSGQKKQIVNQLFKEKRKVTEKDIIHFLHNVDGYDGIELKGIEKQFNASLSTYHDLLKIIKDK
EFMDDPKNEEILENIVHTLTIFEDREMIKQRLAQYDSLFDEKVIKALTRRHYTGWGKLSAKLINGIC
DKKTGKTILDYLIDDGEINRNFMQLIHDDGLSFKEIIQNAQTFGKTDDVKQVVQELPGSPAIKKGIL
QSIKIVDELVKVMGHAPESIVIEMARENQTTARGKKNSQQRYKRIEDSLKNLASGLDSNILKENPTD
NIQLQNDRLFLYYLQNGKDMYTGEALDINQLSSYDIDHIIPQAFIKDDSLDNRVLTSSKDNRGKSDN
VPSEEVVEKMKAFWQQLLDSKLISERKYNNLTKAERERDGLNELDKVGFIKRQLVETRQITKHVA
QILDARFNTEVNEKKQKIRSVKIITLKSNLVSNFRKEFGLYKVREINDYHHAHDAYLNAVLAKAILK
KYPKLEPEFVYGDYQKYDLKRYISKSKEPKDIEKATEKYFFYSNLLNFFKEEVHYADGTIVKRENIE
YSKDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 34 | MTKPYSIGLDIGTNSVGWAVITDSYKVPSKKMKVLGNTSKKYVKKNLLGALLFESGITAEGRRLK
RTARRRYTRRRNRILYLQEIFSTEMNKIDESFFQRLDDSFLVPDDKRDSKYPIFGNLVEEKAYHDEF
PTIYHLRKYLADSQKKADLRLVYLALAHMIKYRGHFLIEGDFNSRNNDIKKNFQDFLDSYNAIFES
DLSLENSKQLEEIVKDKISKSAKKDRILKLFPGEKNSGIFSEFLKLIVGNQADFKKYFNLDEKAPLHF
SKESYDEDLETLLGHIGDDYSDVFLKAKKLYDAILLSGILTVTDNETEAPLSSAMIMRYKEHEEDLA
LLKAYIRKISLETYNEVFKDDTKNGYAGYIDGKTNQEDFYVLKKLLTELKGADYFLDKINREDLL
RKQRTFDNGSIPYQIHLQEMHAILRKQEKFYPPFLAKNKERIEKILTFRIPYYVGPLARGNSDFAWSIR
KRNEKITPWNFEDVIDKESSAEAFINRMTSFDLYLPEEKVLPKHSLLYETFTVYNELTKVRFIAESM
RDYQFLDSKQKKDIVRLYFKGKRKVTDKDIIDYLHAIDGYDGIELKGIEKQFNSSLSTYHDLLNIIN
DKEFLDDSSNEAIIEEIIHTLTIFEDREMIKQRLSKFENIFDKSVLKKLSRRHYTGWGKLSAKLINGIR
DEKSGKTILDYLIDDGISNRNFMQLIHDDTLSFKKKIQKAQIIGDQDNIKQVVQSLPGSPAIKKGILQS
IKIVDELVKVMGRNPESIVVEMARENQYTNQGKSNSQQRLKRLEESLKELGSKILKENVPVKLSKI
DNNALQNERLYLYYLQNGKDMTGQDLDIDRLSNYDIDHIIPQAFLKDNSIDNKVLVSSASNRGKS
DDVPSLDVVKKRKGFWHQLLKSKLISQRKFDNLTKAERGGLTEADKAGFIQRQLVETRQITKHVA
QILDERFNNEVTDKGKKIRKVKIITLKSNLVSQFRKEFGFYKVREINDYHHAHDAYLNAVVATALL
KKYPQLAPEFVYGDYKQVKIDKNGKRTKSQIETSSDKATAKYFFYSNLLNFFKTKVRYADGTVLV
RPVIEYSKDTGEIAWNKEKDFATVRKVLSCPQVNIVKKTEVQTGGFSKESILPKRNSDKLIARKKD
WDPKKYGGFDSPTVAYSVLVVAKVEKGKSKKLKSVKELLGITIMERSSFEKNPIDFLEAKGYKEVR
KDLIVKLPKYSLFELENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQAENIIHLFTLTNLGAPAAF
KYFDTTIDRKRYTSTKEVLDATFIHQSITGLYETRIDLSQLGGD |
| 35 | MTKPYSIGLDIGTNSVGWAVITDNYKVPSKKMKVLGNTSKKYVKKNLLGALLFESGITAEGRRLK
RTARRRYTRRRNRILYLQEIFATEMAKIDESFFQRLDDSFLVPDDKRDSKYPIFGNLVEEKTYHDEF
PTIYHLRKYLADSSKKADLRLVYLALAHMIKYRGHFLIEGDFNSRNNDIKKNFQDFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLA
ALKQFIQNNLQEKYDEVFSDQSKDGYAGYIDGKTTQEAFYKYIKNLLSKFEGADYFLDKIEREDFL
RKQRTFDNGSIPHQIHLQEMNAILRRQGEHYPFLKENKEKIEKILTFRIPYYVGPLARGNRDFAWLT
RNSDQAIRPWNFEEVVDKASSAEDFINKMTNYDLYLPEEKVLPKHSLLYETFAVYNELTKVKFIAE
GLRDYQFLDSGQKKQIVNQLFKEKRKVTEKDIIHFLHNVDGYDGIELKGIEKQFNASLSTYHDLLKI
IKDKEFMDDPKNEEILENIVHTLTIFEDREMIKQRLNQYDSLFDEKVIKALTRRHYTGWGKLSAKLI
NGIRDKQTGKTILDYLIDDGYSNRNFMQLINDDGLSFKEIIQKAQVVGESDNLKQVVQNLPGSPAIK
KGILQSIKIVDELVKVMGHDPEQIVIEMARENQTTNQGRRNSQQRYKKIENAIKNLDSNLNSKILKE
YPTDNKALQNERLFLYYLQNGRDMYRDEELDINQLSNYDIDHIIVPQAFIKDDSLDNRVLTSSKDN
GKSDNVPNIEIVEKMKGFWRQLLKSKLISQRKFDNLTKAERGGLTEHDKAGFIKRQLVETRQITKH
VAQILDARFNTEVNEKNQKIRTVKIITLKSNLVSNFRKEFGLYKVREINDYHHAHDAYLNAVVAKA
ILKKYPKLEPEFVYGDYQKYDIKRYISRSKDPKEIEKATEKYFFYSNLLNFFKEEVHYADGTIVKRE
NVEYSNDTGEIAWNKEKDFATVRKVLSCPQVNIVKKTEVQTGGFSKESILPKRNSDKLIARKKDW
DPKKYGGFDSPTVAYSVLVVAKVEKGKSKKLKSVKELLGITIMERSSFEKNPIDFLEAKGYKEVRK
DLIVKLPKYSLFELENGRKRMLASAGELQKGNELALPSKYVNFLYLASHYEKLKGSPEDNEQKQLF |

| SEQ ID NO | Nuclease Sequence |
|---|---|
| | VEQHKHYLDEIIEQISEFSKRVILADANLDKVLSAYNKHRDKPIREQAENIIHLFTLTNLGAPAAFKY<br>FDTTIDRKRYTSTKEVLDATFIHQSITGLYETRIDLSQLGGD |
| 36 | MKKPYSIGLDIGTNSVGWAVVTDDYKVPAKKMKVLGNTDKSHIKKNLLGALLFEGGETAEGRRL<br>KRTARRRYTRRRNRILYLQEIFSTEMAKIDESFFQRLDDSFLVPDDKRDSKYPIFGNLVKEKTYHDE<br>FPTIYHLRKYLADSSKKADLRLVYLALAHMIKYRGHFLIEGEFNSRNNDIKKNFQEFLDSYNAIFES<br>DLSLSHSEQVEEIVKDKISKSAKRERVLKLFPDEKSTGLFSEFLKLIVGNQADFKKHFDLEEKAPLQF<br>SKDTYDEDLENLLGQIGDDFADLFLVAKKLYDAILLSGILTVTDPSTKAPLSASMIERYENHQKDLA<br>ALKQFIKNNLSEKYDEVFSDQSKDGYAGYIDGKTTQEAFYKYIKNLLSKLEGADYFLDKIEREDFL<br>RKQRTFDNGSIPHQIHLQEMNAIIRRQGEHYPFLKENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEGL<br>RDYQFLDSGQKKQIVTQLFKEKRKVTEKDIIQFLHNVDGYDGIELKGIEKQFNASLSTYHDLLKIIK<br>DKEFMDDPKNEEILENIVHTLTIFEDREMIKQRLAQYDSLFDEKVIKALTRRHYTGWGKLSAKLING<br>ICDKQTGDTILDFLIDDDKINRNFMQLINDDGLSFKEIIQKAQVVGKTDDLKQVVQELPGSPAIKKGI<br>LQSIKIVDELVKVMGHDPESIVIEMARENQTTNQGRRNSQQRYKKIEEAIKNLDSNLNSKILKEYPT<br>NNQALQNDRLFLYYLQNGKDMYTGEPLDINQLSNYDIDHIVPQAFIKDDSLDNRVLTSSKDNRGKS<br>DNVPSLEVVQKRKAFWQQLLDSKLISERKENNLTKAERGGLDERDKVGFIKRQLVETRQITKHVA<br>QILDARFNTEVNDKKQKIRNVKIITLKSNLVSNFRKEFGLYKVREINDYHHAHDAYLNAVVAKAIL<br>KKYPKLEPEFVYGDYQKYDIKRYISRSKDPKDIEKATEKYFFYSNLLNFFKEEVHYADGTIIKRENIE<br>YSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 37 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSTKKADLRLVYLALAHMIKYRGHFLIEGDFNSRNNDIKKNFQDFLDSYNAIFESD<br>LSLENSKQLEEIVKDKISKSAKKDRLLKLFPGEKNSGIFSEFLKLIVGNQADFRKYFNLDEKASLHES<br>KESYDEDLETLLGHIGDDYSDVFLKAKKLYDAILLSGILTVTDNETEAPLSSAMIMRYKEHEEDLAL<br>LKAYIRKISLETYNEVFKDDTKNGYAGYIDGKTNQEDFYVYLKKLLTGLEGADYFLEKINREDLLR<br>KQRTFDNGSIPYQIHLQEMRAIIDKQAKFYPFLAKNKERIEKILTFRIPYYVGPLARGNSDFAWSIRK<br>RNEKITPWNFEDVIDKESSAEAFINRKMTSFDLYLPEEKVLPKHSLLYETFTVYNELTKVRFIAESMR<br>DYQFLDSKQKKDIVRLYFKGKRKVTDKDIIEYLHAIDGYDGIELKGIEKQFNSSLSTYHDLLNIINDK<br>EFLDDSSNEAIIEEIIHTLTIFEDREMIKQRLSKFENIFDKSVLKKLSRRHYTGWGKLSAKLINGIRDE<br>KSGKTILDYLIDDGVSNRNFMQLIHDDTLSFKKKIQKAQIIGDQDNIKQVVQSLPGSPAIKKGILQSI<br>KIVDELVKVMGRNPEHIVVEMARENQFTNQGRRNSQQRLKRLEESLKELGSKILKENVPAKLSKID<br>NNALQNDRLYLYYLQNGKDMYTGEELDIDRLSDYDIDHIIPQAFLKDDSIDNRVLVSSASNRGKSD<br>DVPSLEVVKRRKNFWRQLLKSKLISQRKFDNLTKAERGGLTEKDKAGFIHRQLVETRQITKHVAQL<br>LDSRFNTKRDDAGKVIREVKIITLKSSLVSQPRKDFKLYKVREINDYHHAHDAYLNAVVATAILKK<br>YPKLEPEFVYGNYRDYQKYLMIKSDKDYGKATAKMFFYSNLMNFFKKEVRLSDGTVIVRPVIEYS<br>KDTGEIAWNKEKDFATVRKVLSCPQVNIVKKTEVQTGGFSKESILPKRNSDKLIARKKDWDPKY<br>GGFDSPTVAYSVLVVAKVEKGKSKKLKSVKELLGITIMERSSFEKNPIDFLEAKGYKEVRKDLIVKL<br>PKYSLFELENGRKRMLASAGELQKGNELALPSKYVNFLYLASHYEKLKGSPEDNEQKQLFVEQHK<br>HYLDEIIEQISEFSKRVILADANLDKVLSAYNKHRDKPIREQAENIIHLFTLTNLGAPAAFKYFDTTID<br>RKRYTSTKEVLDATFIHQSITGLYETRIDLSQLGGD |
| 38 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQEFLDSYNAIFESDL<br>SLENSKQLEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLAAL<br>KQFIKNNLSEKYDEVFSDQSKDGYAGYIDGKTTQEAFYKYIKNLLTKFEGADYFLEKIKREDFLRK<br>QRTFDNGSIPYQVHLQEMKAILSRQGDYYPFLKENKEKIEKILTFRIPYYVGPLARGNRDFAWLTRN<br>SDQAIRPWNFEEVVDKASSAEDFINKMTNYDLYLPEEKVLPKHSLLYETFAVYNELTKVKFIAEGL<br>RDYQFLDSGQKKQIVNQLFKEKRKVTEKDIIHYLHNVDGYDGIELKGIEKQFNASLSTYHDLLKIIK<br>DKEFMDDAKNEEILENIIHTLTIFEDREMIKQRLAQYDSLFDEKVIKALTRRHYTGWGKLSAKLING<br>IYDKQSKKTILDYLIDDDKINRNFMQLINDDGLSFKEIIQKAQVVGKTDDLKQVVQNLPGSPAIKKG<br>ILQSIKIVDELVKVMGHAPESIVIEMARENQTTNQGKRNSQQRYKRIEDAVKNLASELDGNILKEYP<br>TNNQALQNDRLFLYYLQNGKDMYTGEPLDINQLSSYDIDHIIPQAFIKDDSLDNRVLTSSKDNRGK<br>SDNVPSLEVVQKRKAFWQQLLDSKLISERKFNNLTKAERGGLDERDKVGFIKRQLVETRQITKHVA<br>QILDARFNTEVNEKNQKIRTVKIITLKSNLVSNFRKEFGLYKVREINDYHHAHDAYLNAVVAKAIL<br>KKYPKLEPEFVYGDYQKYDLKRYISKRNPKAIDKATQKYFFYSNLLNFFKEEVHYADGTIIKRENI<br>EYSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 39 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKKDRLLKLFPGEKNSGIFSEFLKLIVGNQADFRKYFNLDEKASLHES<br>KESYDEDLETLLGHIGDDYSDVFLKAKKLYDAILLSGILTVTDNETEAPLSSAMIMRYKEHEEDLAL |

| SEQ ID NO | Nuclease Sequence |
|---|---|
| | LKAYIRKISLETYNEVFKDDTKNGYAGYIDGKTNQEDFYVYLKKLLTGLEGADYFLEKINREDLLR<br>KQRTFDNGSIPYQIHLQEMRAIIDKQAKFYPPFLAKNKERIEKILTFRIPYYVGPLARGNSDFAWSIRK<br>RNEKITPWNFEDVIDKESSAEAFINRMTSFDLYLPEEKVLPKHSLLYETFTVYNELTKVRFIAESMR<br>DYQFLDSKQKKDIVRLYFKGKRKVTDKDIIDYLHAIDGYDGIELKGIEKQFNSSLSTYHDLLNIIND<br>KEFLDDSSNEAIIEEIIHTLTIFEDREMIKQRLSKFENIFDKSVLKKLSRRHYTGWGKLSAKLINGIRD<br>EKSGKTILDYLIDDGISNRNFMQLIHDDTLSFKKKIQKEQYIEDQDNIKQVVQSLPGSPAIKKGILQSI<br>KIVDELVKVMGGRKPESIVVEMARENQYTNQGKSNSQQRLKRLEESLKELGSKILKENVPAKLSKI<br>DNNALQNERLYLYYLQNGKDMYTGDDLDIDRLSNYDIDHIIPQAFLKDNSIDNKVLVSSASNRGKS<br>DDVPSLDVVKKRKTFWHQLLKSKLISQRKFDNLTKAERGGLTEDDKAGFIRRQLVETRQITKHVA<br>QLLDSRFNTKRDDNDKVIRDVKIITLKSSLVSQFRKDFKLYKVREINDYHHAHDAYLNAVVATAIL<br>KKYPKLEPEFVYGEYKKYDVRKFIAKSDKDLGKATAKLFFYSNLMNFFKKEVRLADGTVVVRPVI<br>EYSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 40 | MNKPYSIGLDIGTNSVGWAVITDDYKVPSKKMKVLGNTSKKYVKKNLLGALLFESGITAEGRRLK<br>RTARRRYTRRRNRILYLQEIFSTEMNKIDEGFFQRLDDSFLVPDDKRDSKYPIFGNLVEEKAYHDEF<br>PTIYHLRKYLADSSKKADLRLVYLALAHMIKYRGHFLIEGDFNSRNNDIKKNFQEFLDSYNAIFESD<br>LSLENSKQLEEIVKDKISKSAKRERVLRLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIQNNLQEKYDEVFSDQSKDGYAGYIDGKTTQEAFYKYINKLLAKFEGADYFLEKIKREDFL<br>RKQRTFDNGTIPYQVHLAEMRAILHRQGDYYPPFLKENKEKIEKILTFRIPYYVGPLARGNRDFAWL<br>TRNSDQAIRPWNFEEIVDQASSAEEFINKMTNYDLYLPEEKVLPKHSLLYETFAVYNELTKVKFIAE<br>GLRDYQFLDSGQKKQIVNQLFKEKRKVTEKDIIQFLHNVDGYDGIELKGIEKQFNASLSTYHDLLKI<br>IKDKDFMDDPKNEEILENIVHTLTIFEDREMIKQRLAQYDSLFDEKVIKALTRRHYTGWGKLSAKLI<br>NGIYDKQSKKTILDYLIDDGKINRNFMQLINDDGLSFKDIIQKAQVVGKTDDVKQVVQELPGSPAIK<br>KGILQSIKIVDELVKVMGHAPESIVIEMARENQTTARGKKNSQQRYKRIEDALKNLAPGLDSNILKE<br>HPTDNIQLQNDRLFLYYLQNGKDMYTGEPLDINQLSSYDIDHIVPQAFIKDDSLDNRVLTSSKDNR<br>GKSDNVPSLEVVQKRKAFWQQLLDSKLISERKENNLTKAERGGLDERDKVGFIKRQLVETRQITKH<br>VAQILDARFNTEVNEENQRIRKVKIITLKSNLVSNFRKEFGLYKVREINDYHHAHDAYLNAVVAKA<br>ILKKYPKLEPEFVYGDYQKYDIKRYISRSKDPKDIEKATEKYFFYSNLLNFFKEEVHYADGTIIKREN<br>IEYSKDTGEIAWNKEKDFATVRKVLSCPQVNIVKKTEVQTGGFSKESILPKRNSDKLIARKKDWDP<br>KKYGGFDSPTVAYSVLVVAKVEKGKSKKLKSVKELLGITIMERSSFEKNPIDFLEAKGYKEVRKDL<br>IVKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 41 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSQKKADLRLVYLALAHMIKYRGHFLIEGDFNSRNNDIKKNFQDFLDSYNAIFESD<br>LSLENSKQLEEIVKDKISKSAKRERVLKLFPDEKSTGLFSEFLKLIVGNQAEFKKHFDLEEKAPLQFS<br>KDTYDEDLENLLGQIGDDFADLFLVAKKLYDAILLSGILTVTDPSTKAPLSASMIERYENHQKDLA<br>ALKQFIKSNLSEKYDEVFSDQSKDGYAGYIDGKTTQEAFYKYIKNLLSKFEGADYFLDKIEREDFLR<br>KQRTFDNGSIPHQIHLQEMNAILRRQGEHYPPFLKENKEKIEKILTFRIPYYVGPLARGNRDFAWLTR<br>NSDQAIRPWNFEEVVDQASSAEEFINKMTNYDLYLPEEKVLPKHSLLYETFAVYNELTKVKFIAEG<br>LRDYQFLDSGQKKQIVNQLFKEKRKVTEKDIIQFLHNVDGYDGIELKGIEKQFNASLSTYHDLLKII<br>KDKEFMDDPKNEEILENIVHTLTIFEDREMIKQRLAQYDSLFDEKVIKALTRRHYTGWGKLSAKLIN<br>GICDKQTNKTILDYLIDDDKINRNFMQLIHDDGLSFKDIIQKAQVVGKTDDVKQVVQELPGSPAIKK<br>GILQSIKIVDELVKVMGHAPESIVIEMARENQTTNQGRRNSQQRYKKIEEAIKNLDSNLNSKILKEYP<br>TDNQALQNDRLFLYYLQNGKDMYTDEELDINQLSNYDIDHIVPQAFIKDDSLDNRVLTSSKDNRG<br>KSDNVPSLEVVQKRKGFWQQLLDSKLISEHKFNNLTKAERGGLDERDKVGFIKRQLVETRQITKH<br>VAQILDARFNTEVDENNQKIRTVKIITLKSNLVSNFRKEFGLYKVREINDYHHAHDAYLNAVVAKA<br>ILKKYPKLEPEFVYGDYQKYDLKRYISKSKDPKEIEKATEKYFFYSNLLNFFKEEVHYADGTIIKRE<br>NIEYSKDTGEIAWNKEKDFATVRKVLSCPQVNIVKKTEVQTGGFSKESILPKRNSDKLIARKKDWD<br>PKKYGGFDSPTVAYSVLVVAKVEKGKSKKLKSVKELLGITIMERSSFEKNPIDFLEAKGYKEVRKD<br>LIVKLPKYSLFELENGRKRMLASAGELQKGNELALPSKYVNFLYLASHYEKLKGSPEDNEQKQLFV<br>EQHKHYLDEIIEQISEFSKRVILADANLDKVLSAYNKHRDKPIREQAENIIHLFTLTNLGAPAAFKYF<br>DTTIDRKRYTSTKEVLDATFIHQSITGLYETRIDLSQLGGD |
| 42 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>QLKQFVKTNLPEKYDEVFSDQSKDGYAGYIDGKTTQEAFYVYLKKLLTGLEGADYFLEKIKREDF<br>LRKQRTFDNGSIPYQVHLQEMQAILHRQGEYYPPFLKENKEKIQQILTFRIPYYVGPLARGNRDFAW<br>LTRNSDQAIRPWNFEEIVDKASSAEEFINKMTNYDLYLPEEKVLPKHSLLYETFAVYNELTKVKFIA<br>EGLRDYQFLDSGQKKQIVNQLFKDKRKVTEKDIIHYLHNVDGYDGIELKGIEKQFNASLSTYHDLL<br>KIIKDKEFMDDPKNEEILENIVHTLTIFEDREMIKQRLAQYDSLFDEKVIKALTRRHYTGWGKLSAK<br>LINGICDKQTNKTILDYLIDDDKINRNFMQLINDDGLSFKDIIQKAQVVGKTDDVKQVVQELPGSPA<br>IKKGILQSIKIVDELVKVMGHAPESIVIEMARENQTTARGKKNSQQRYKRIEDALKNLAPGLDSNIL<br>KENPTDNIQLQNDRLFLYYLQNGKDMYTGKELDINQLSNYDIDHIIPQAFIKDDSLDNRVLTSSKDN |

| SEQ ID NO | Nuclease Sequence |
|---|---|
| | RGKSDNVPSIEVVQKRKAFWQQLLDSKLISERKENNLTKAERERGGLNELDKVGFIKRQLVETRQI
TKHVAQILDAKFNTEKDENGKRIRKVKIITLKSNLVSNFRKEFGLYKVREINDYHHAHDAYLNAVV
AKAILKKYPKLEPEFVYGDYQKYDIKRYISRSKDPKDIEKATEKYFFYSNLLNFFKEEVHYADGTII
KRENIEYSKDTGEIAWNKEKDFATVRKVLSCPQVNIVKKTEVQTGGFSKESILPKRNSDKLIARKK
DWDPKKYGGFDSPTVAYSVLVVAKVEKGKSKKLKSVKELLGITIMERSSFEKNPIDFLEAKGYKEV
RKDLIVKLPKYSLFELENGRKRMLASAGELQKGNELALPSKYVNFLYLASHYEKLKGSPEDNEQK
QLFVEQHKYLDEIIEQISEFSKRVILADANLDKVLSAYNKHRDKPIREQAENIIHLFTLTNLGAPAA
FKYFDTTIDRKRYTSTKEVLDATFIHQSITGLYETRIDLSQLGGD |
| 43 | MNKPYSIGLDIGTNSVGWAVVDDDYKVPAKKMRVFGDTDRSHIKKNLLGTLLFDSGETAEGRRL
KRTARRRYTRRRNRILYLQEIFAEEMSKVDDSFFHRLDESFLTDDDKNFDSHPIFGNKAEEDAYHQ
KFPTIYHLRKHLADSTEKADLRLVYLALAHMIKFRGHFLIEGQLNAENTDVQKLFADFVGVYDRTF
DDSHLSEITVDASSILTEKISKSRRLENLITHYPKEKKNTLFGNLIALALGLQPNFKTNFKLSEDAKL
QFSKDTYEEDLEELLGKIGDDYADLFTSAKNLYDAILLSGILTVDDESTKAPLSASMVKRYAEHHE
DLEKLKEFIKANKPELYHDIFKDETKNGYAGYIENGVKQDEFYKYLKNTLSKIAGSDYFLDKIERE
DFLRKQRTFDNGSIPHQIHLQEMHAILRRQGDYYPFLKENQDRIEKILTFRIPYYVGPLARKDSRFA
WANYHSEEKITPWNFDKVIDKEKSAEKFITRMTSNDLYLPEEKVLPKHSLLYETYTVYNELTKVKY
VNEQGNATFFDSNIKQEIFEQLFKTKRKVTKKDIINYLENAYCIDDVEIMGVEDRFNASLGTYHDLL
KIIQDKSFLDDKKNEEIIEDVVLTLTLFEDRDMIRQRLQKYSDIFTKQQLKKLERRHYTGWGRLSYK
LINGIRNKENNKTILDFLIDDGRANRNFMQLINDDSLSFKTIIQEAQVVGDVDDIETVVHDLPGSPAI
KKGILQSIKIVDELVKVMGHNPDNIVIEMARENQTTNRGRSQQRLKKLQESLKELGSSILNKEKP
SYIEDKVENSHLQNDKLFYYIQNGKDMYTGEELDIDHLSDYDIDHIIPQAFIKDDSIDNRVLTSSAK
NRGKSDDVPSLDIVRDRKAEWIRLYKSKLISRKFDNLTKAERGGLTENDKAGFIKRQLVETRQIT
KHVAQILDARFNTERDENDKVIRDVKVITLKSNLVSQFRKEFGFYKVREINDYHHAHDAYLNAVV
GTALLKKYPKLAPEFVYGEYQKYDVRKFISTKDNKDIGKATAKYFFYSNLLNFFKEEVRYANGTII
VRPVIEYSKDTGEIAWNKEKDFATVRKVLSCPQVNIVKKTEVQTGGFSKESILPKRNSDKLIARKKD
WDPKKYGGFDSPTVAYSVLVVAKVEKGKSKKLKSVKELLGITIMERSSFEKNPIDFLEAKGYKEVR
KDLIVKLPKYSLFELENGRKRMLASAGELQKGNELALPSKYVNFLYLASHYEKLKGSPEDNEQKQ
LFVEQHKYLDEIIEQISEFSKRVILADANLDKVLSAYNKHRDKPIREQAENIIHLFTLTNLGAPAAF
KYFDTTIDRKRYTSTKEVLDATFIHQSITGLYETRIDLSQLGGD |
| 44 | MTKPYSIGLDIGTNSVGWAVITDNYKVPSKKMKVLGNTSKKYVKKNLLGALLFESGITAEGRRLK
RTARRRYTRRRNRILYLQEIFSTEMNKIDEGFFQRLDDSFLVPDDKRDSKYPIFGNLVEKTYHDEF
PTIYHLRKYLADSSKKADLRLVYLALAHMIKYRGHFLIEGDFNSRNNDIKKNFQDFLDSYNAIFESD
LSLENSKQLEEIVKDKISKSAKRERVLKLFPDEKSTGLFSEFLKLIVGNQADFKKHPDLEEKAPLQFS
KDTYDEDLENLLGQIGDDFADLFLVAKKLYDAILLSGILTVTDPSTKAPLSASMIERYENHQKDLA
ALKQFIQNNLQEKYDEVFSDQSKDGYAGYINGKTTQEAFYKYIKNLLSKFEGADYFLDKIEREDFL
RKQRTFDNGSIPHQIHLQEMNAIIRRQGEHYPFLKENKEKIEKILTFRIPYYVGPLARGNRDFAWLTR
NSDQAIRPWNFEEIVDKASSAEDFINKMTNYDLYLPEEKVLPKHSLLYETFAVYNELTKVKFIAEGL
RDYQFLDSGQKKQIVNQLFKEKRKVTEKDIIHYLHNVDGYDGIELKGIEKQFNASLSTYHDLLKIIK
DKEFMDDPKNEEILENIVHTLTIFEDREMIKQRLAQYDSLFDEKVIKALTRRHYTGWGKLSAKLING
IYDKQSKKTILDYLIDDDKINRNFMQLINDDGLSFKEIIQKAQVVGKTNDVKQVVQELPGSPAIKG
ILQSIKIVDELVKVMGGDPEHIVVEMARENQFTNQGRRNSQQRYKKIEDAIKNLDSNLNSKILKEYP
TDNQALQNDRLFLYYLQNGKDMYTGEELDINQLSNYDIDHIVPQAFIKDDSLDNRVLTSSKDNRG
KSDNVPSLEVVKRKAFWQQLLDSKLISERKENNLTKAERGGLDERDKVGFIRRQLVETRQITKHV
AQILDARFNTEVNEKGKKIRKVKIITLKSNLVSNFRKEFGLYKVREINDYHHAHDAYLNAVVAKAI
LKKYPKLEPEFVYGDYQKYDIRDFIKAKRKTTDDKATAKYFFYSNLLNFFKKEVRYADGTVIVRPI
VEYSKDTGEIAWNKEKDFATVRKVLSCPQVNIVKKTEVQTGGFSKESILPKRNSDKLIARKKDWDP
KKYGGFDSPTVAYSVLVVAKVEKGKSKKLKSVKELLGITIMERSSFEKNPIDFLEAKGYKEVRKDL
IVKLPKYSLFELENGRKRMLASAGELQKGNELALPSKYVNFLYLASHYEKLKGSPEDNEQKQLFVE
QHKYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 45 | MTKPYSIGLDIGTNSVGWAVITDNYKVPSKKMKVLGNTSKKYVKKNLLGALLFESGITAEGRRLK
RTARRRYTRRRNRILYLQEIFSTEMSKVDENFFQRLDDSFLVPDDKRDSKYPIFGNLVEEKTYHDEF
PTIYHLRKYLADSSKKADLRLVYLALAHMIKYRGHFLIEGDFNSRNNDIKKNFQQFLDSYNAIFESD
LSLENSAQVEEIVKDKISKSAKRERVLKLFPDEKSTGLFSEFLKLIVGNQADFKKHFNLEEKAPLHES
KDTYDEDLENLLGQIGDDFADLFLVAKKLYDAILLSGILTVTDPSTKAPLSASMIERYENHQKDLAT
LKQFIKNNLSEKYDEVFSDQSKDGYAGYIDGKTTQEAFYKYIKNLLSKFEGADYFLDKIERENFLR
KQRTFDNGSIPHQIHLQEMHAILHRQGEHYPFLKENKEKIEKILTFRIPYYVGPLARGNRDFAWLTR
NSDQAIRPWNFEEVVDKASSAEDFINKMTNYDLYLPEEKVLPKHSLLYETFAVYNELTKVKFIAEG
LRDYQFLDSGQKKQIVNQLFKEKRKVTEKDIIQFLHNVDGYDGIELKGIEKQFNASLSTYHDLLKII
KDKEFMDDPKNEEILENIIHTLTIFEDREMIKQRLAQYDSLFDEKVIKALTRRHYTGWGKLSAKLIN
GIRDKKTGKTILDYLIDDGKINRNFMQLIHDDGLSFKEIIQKAQVVGDTDDLKQVVQELPGSPAIKK
GILQSIKIVDELVKVMGHNPENIVVEMARENQFTNQGRRNSQQRYKKIKDAIKNLDSNLNSKILKE
YPTNNQALQNDRLFLYYLQNGKDMYTGEALDINQLSNYDIDHIIPQAFIKDDSLDNRVLTSSKDNR
GKSDNVPSIEVVEKMKAFWQQLLDSKLISERKENNLTKAERERGGLNELDKVGFIKRQLVETRQIT
KHVAQILDARFNTEVNEKKQKIRSVKIITLKSNLVSNFRKEFGLYKVREINDYHHAHDAYLNAVVA
KAILKKYPKLEPEFVYGDYQKYDVRKFISTKDNEIGKATAKYFFYSNLLNFFKTKVRYADGTVIV
RPVIEYSKDTGEIAWNKEKDFATVRKVLSCPQVNIVKKTEVQTGGFSKESILPKRNSDKLIARKKD
WDPKKYGGFDSPTVAYSVLVVAKVEKGKSKKLKSVKELLGITIMERSSFEKNPIDFLEAKGYKEVR
KDLIVKLPKYSLFELENGRKRMLASAGELQKGNELALPSKYVNFLYLASHYEKLKGSPEDNEQKQ
LFVEQHKYLDEIIEQISEFSKRVILADANLDKVLSAYNKHRDKPIREQAENIIHLFTLTNLGAPAAF
KYFDTTIDRKRYTSTKEVLDATFIHQSITGLYETRIDLSQLGGD |

| SEQ ID NO | Nuclease Sequence |
|---|---|
| 46 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKVYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIQNNLQEKYDEVFSDQSKDGYAGYIDGKTTQEAFYKYIKNLLSKFEGADYFLEKIEREDFL<br>RKQRTFDNGSIPHQIHLQEMNAILRRQGEYYPFLKENKEKIQQILTFRIPYYVGPLARGNRDFAWLT<br>RNSDQAIRPWNFEEVVDKASSAEDFINKMTNYDLYLPEEKVLPKHSLLYETFAVYNELTKVKFIAE<br>GLRDYQFLDSGQKKQIVNQLFKEKRKVTEKDIIHYLHNVDGYDGIELKGIEKQFNASLSTYHDLLKI<br>IKDKEFMDDPKNEEILENIVHTLTIFEDREMIKQRLAQYDSLFDEKVIKALTRRHYTGWGKLSAKLI<br>NGIYDKQSKKTILDYLIDDDKINRNFMQLINDDGLSFKEIIQKAQVVGKTDDVKQVVQELPGSPAIK<br>KGILQSIKIVDELVKVMGHAPESIVIEMARENQTTARGKKNSQQRYKRIEDALKNLAPGLDSNILKE<br>NPTDNIQLQNDRLFLYYLQNGKDMYTGESLDINQLSNYDIDHIIPQAFIKDDSLDNRVLTSSKDNRG<br>KSDNVPSIEIVEKMKGFWQQLLNSKLISERKFNNLTKAERGGLSELDKAGFIKRQLVETRQITKHVA<br>QILDARYNEEVDNNQKIRKVKIITLKSNLVSNFRKEFGLYKVREINDYHHAHDAYLNAVVAKAILK<br>KYPKLEPEFVYGDYQKYDIKRYISKSKDPKDIEKATQKYFFYSNLLNFFKEEVHYADGTIIKRENIE<br>YSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 47 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDGFADLFLVAKKLYDAILLSGILTVTDPSTKAPLSASMIERYENHQKDLSA<br>LKQFIKRNLSEKYDEVFSDQSKDGYAGYINGKTTQEAFYKYIKNLLSKFEGADYFLDKIEREDFLR<br>KQRTFDNGSIPHQIHLQEMNAIIRRQGEHYPFLQENKEKIEKILTFRIPYYVGPLARGNRDFAWLTR<br>NSDQAIRPWNFEEVVDKARSAEDFINKMTNYDLYLPEEKVLPKHSLLYETFAVYNELTKVKFIAEG<br>LRDYQFLDSGQKKQIVNQLFKEKRKVTEKDIIQFLHNVDGYDGIELKGIEKQFNASLSTYHDLLKII<br>KDKEFMDDPKNEEILENIIHTLTIFEDREMIKQRLAQYDSLFDEKVIKALTRRHYTGWGKLSAKLIN<br>GIYDKQSKKTILDYLIDDGEINRNFMQLIHDDGLSFKEIIQKAQVVGETDDLRQVVQNLPGSPAIKK<br>GILQSIKLVDELVKVMGHEPEQIVIEMARENQTTNQGKRNSQQRYKRIEDGVKNLASDLNGNILKE<br>YPTDNQALQNDRLFLYYLQNGKDMYTGEALDINQLSNYDIDHIVPQAFIKDDSLDNRVLTSSKDN<br>RGKSDNVPSIEVVQKRKAFWQQLLDSKLISERKFNNLTKAERGGLDERDKVGFIKRQLVETRQITK<br>HVAQILDARFNTEVNEKGKRIRKVKIITLKSNLVSNFRKEFGLYKVREINDYHHAHDAYLNAVVAK<br>AILKKYPKLEPEFVYGDYQKYDIKRYISRSKDPKDIEKATEKYFFYSNLLNFFKEEVHYADGTIIKRE<br>NIEYSKDTGEIAWNKEKDFATVRKVLSCPQVNIVKKTEVQTGGFSKESILPKRNSDKLIARKKDWD<br>PKKYGGFDSPTVAYSVLVVAKVEKGKSKKLKSVKELLGITIMERSSFEKNPIDFLEAKGYKEVRKD<br>LIVKLPKYSLFELENGRKRMLASAGELQKGNELALPSKYVNFLYLASHYEKLKGSPEDNEQKQLFV<br>EQHKHYLDEIIEQISEFSKRVILADANLDKVLSAYNKHRDKPIREQAENIIHLFTLTNLGAPAAFKYF<br>DTTIDRKRYTSTKEVLDATFIHQSITGLYETRIDLSQLGGD |
| 48 | MKKPYSIGLDIGTNSVGWAVITDSYKVPSKKMKVLGNTSKKYVKKNLLGALLFESGITAEGRRLK<br>RTARRRYTRRRNRILYLQEIFAEEMNKIDESFFHRLDDSFLVPEDKRGSKYPIFATLEEEKEYHKQFP<br>TIYHLRKHLADSKEKTDLRLIYLALAHMIKYRGHFLYEESFDIKNNDIQKIFNEFISIYDNTFEGSSLS<br>GQNAQVEAIFTDKISKSAKRERVLKLFPDEKSTGLFSEFLKLIVGNQADFKKHFDLEEKAPLQFSKD<br>TYDEDLENLLGQIGDDFADLFLVAKKLYDAILLSGILTVTDPSTKAPLSASMIERYENHQKDLAAL<br>QFIQNNLQEKYDEVFSDQSKDGYAGYINGKTTQEAFYKYIKNLLNKVEGADYFLDKIEREDFLRKQ<br>RTFDNGSIPHQIHLQEMHAILQRQGEHYPFLKDNKEKIEKILTFRIPYYVGPLARGNRDFAWLTRNS<br>DQAIRPWNFEEVVDQASSAEDFINKMTNYDLYLPEEKVLPKHSLLYETFAVYNELTKVKFIAEGLR<br>DYQFLDSGQKKQIVNQLFKEKRKVTEKDIIHYLHNVDGYDGIELKGIEKQFNASLATYHLLKQID<br>KEFMDDPKNEEILEKIIHTLTLFEDREMIKQRLEQYADIFDKSVLKKLSRRHYTGWGKLSAKLINGI<br>RDKKTGKTILDYLIDDGYSNRNFMQLINDDSLSFKEKIKEAQRSGEGDDLREEVQNLAGSPAIKKGI<br>LQSLKIVDELIEVMGYDPEHIVVEMARENQFTNQGRRNSQQRYKKLKNAIKNLDNNLNSKILKEYP<br>TNNQALQNDRLFLYYIQNGKDMYTGEELDIDNLSQYDIDHIIPQAFIKDDSIDNRVLTSSAKNRGKS<br>DDVPSIEIVKDRRNFWKQLLDSQLISQRKFDNLTKAERGGLTEADKAGFIKRQLVETRQITKHVAQI<br>LDARFNTKRDENDKVIRDVKVITLKSNLVSQFRKDFQFYKVREINDYHHAHDAYLNAVVGTALIK<br>KYPKLESEFVYGDYKVYDVRRMIAKSEQEIGKATAKRFFYSNILNFFKTEIKLANGEIRKRPLIETNE<br>ETGEIVWNKEKDFATVRKVLSCPQVNIVKKTEVQTGGFSKESILPKRNSDKLIARKKDWDPKKYG<br>GFDSPTVAYSVLVVAKVEKGKSKKLKSVKELLGITIMERSSFEKNPIDFLEAKGYKEVRKDLIVKLP<br>KYSLFELENGRKRMLASAGELQKGNELALPSKYVNFLYLASHYEKLKGSPEDNEQKQLFVEQHKH<br>YLDEIIEQISEFSKRVILADANLDKVLSAYNKHRDKPIREQAENIIHLFTLTNLGAPAAFKYFDTTIDR<br>KRYTSTKEVLDATFIHQSITGLYETRIDLSQLGGD |
| 49 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKKDRLLKLFPGEKNSGIFSEFLKLIVGNQADFRKYFNLDEKASLHES<br>KESYDEDLETLLGHIGDDYSDVFLKAKKLYDAILLSGILTVTDNETEAPLSSAMIRYKEHEEDLAL<br>LKAYIRNISLETYNEVFKDDTKNGYAGYIDGKTNQEDFYVYLKKLLTGLEGADYFLEKINREDLLR<br>KQRTFDNGSIPYQIHLQEMRAIIDKQAKFYPFLAKNKERIEKILTFRIPYYVGPLARGNSDFAWSIRK |

| SEQ ID NO | Nuclease Sequence |
|---|---|
| | RNEKITPWNFEDVIDKESSAEAFINRMTSFDLYLPEEKVLPKHSLLYETFTVYNELTKVRFIAESMR<br>DYQFLDSKQKKDIVRLYFKGKRKVTDKDIIEYLHAIDGYDGIELKGIEKQFNSSLSTYHDLLNIINDK<br>EFLDDSSNEAIIEEIIHTLTIFEDREMIKQRLSKFENIFDKSVLKKLSRRHYTGWGKLSAKLINGIRDE<br>KSGKTILDYLIDDGISNRNFMQLIHDDTLSFKKKIQKAQIIGDKDNIKQVVQSLPGSPAIKKGILQSIK<br>IVDELVKVMGGRKPESIVVEMARENQYTNQGKSNSQQRLKRLEESLKELGSKILKENVPAKLSKID<br>NNALQNERLYLYYLQNGKDMYTGDDLDIDRLSNYDIDHIIPQAFLKDNSIDNKVLVSSASNRGKSD<br>DVPSLDVVKKRKGFWHQLLKSKLISQRKFDNLTKAERGGLSPEDKAGFIQRQLVETRQITKHVARI<br>LDERFNNEVNDKGQRIRKVKIITLKSSLVSQFRKEFGLYKVREINDYHHAHDAYLNAVVATAILKK<br>YPKLEPEFVYGDYQKYDVRKYLSTKDNKDLGKATAKLFFYSNLMNFFKKEVRLSDGTVIVRPVIE<br>YSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 50 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDGFADLFLVAKKLYDAILLSGILTVTDPSTKAPLSASMIERYENHQKDLA<br>ALKQFIQNNLQEKYDEVFSDQSKDGYAGYINGKTTQEAFYKYIKNLLSKLEGADYFLDKIEREDFL<br>RKQRTFDNGSIPHQIHLQEMNAILRRQGEHYPFLKENKEKIEKILTFRIPYYVGPLARGNRDFAWLT<br>RNSDQAIRPWNFEEIVDQASSAEDFINKMTNYDLYLPEEKVLPKHSLLYETFAVYNELTKVKFIAEG<br>LRDYQFLDSGQKKQIVNQLFKEKRKVTEKDIIQFLHNVDGYDGIELKGIEKQFNASLSTYHDLLKII<br>KDKEFMDDPKNEEILENVVHTLTIFEDREMIKQRLTQYASIFDEKVIKALSRRHYTGWGRLSAKLIN<br>GIRDKQSQKTILDYLIDDDKINRNFMQLINDDGLSFKDIIQKAQVVGKTDDVKQVVQELPGSPAIKK<br>GILQSIKIVDELVKVMGHAPESIVIEMARENQTTARGKKNSQQRYKRIEDALKNLAPELDGNILKEY<br>PTDNQALQNDRLFLYYLQNGKDMYTGEELDINQLSNYDIDHIVPQAFIKDDSLDNRVLTSSKDNRG<br>KSDNVPSLEVVQKRKAFWQQLLDSKLISERKENNLTKAERGGLSDERDKVGFIKRQLVETRQITKHV<br>AQILDARFNTEVDEKGKKIREVKIVTLKSNLVSNFRKEFGLYKVREINDYHHAHDAYLNAVVAKAI<br>LKKYPKLEPEFVYGDYQKYDVKRYISRSKDPKEIEKATEKYFFYSNLLNFFKEEVHYADGTIIKREN<br>IEYSKDTGEIAWNKEKDFATVRKVLSCPQVNIVKKTEVQTGGFSKESILPKRNSDKLIARKKDWDP<br>KKYGGFDSPTVAYSVLVVAKVEKGKSKKLKSVKELLGITIMERSSFEKNPIDFLEAKGYKEVRKDL<br>IVKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 51 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKAYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKKDRLLKLFPGEKNSGIFSEFLKLIVGNQADFRKYFNLDEKASLHES<br>KESYDEDLETLLGHIGDDYSDVFLKAKKLYDAILLSGILTVTDNETEAPLSSAMIMRYKEHEEDLAL<br>LKAYIRKISLETYNEVFKDDTKNGYAGYIDGKTNQEDFYVYLKKLLTGLEGADYFLEKINREDLLR<br>KQRTFDNGSIPYQIHLQEMRAIIDKQAKFYPPLAKNKERIEKILTFRIPYYVGPLARGNSDFAWSIRK<br>RNEKITPWNFEDVIDKESSAEAFINRMTSFDLYLPEEKVLPKHSLLYETFTVYNELTKVRFIAESMR<br>DYQFLDSKQKKDIVRLYFKGKRKVTDKDIIDYLHAIDGYDGIELKGIEKQFNSSLATYHDLLNIIND<br>KEFLDDSSNEAIIEEIIHTLTIFEDREMIKQRLSKFENIFDKSVLKKLSRRHYTGWGKLSAKLINGIRD<br>EKSGKTILDYLIDDGVSNRNFMQLIHDDALSFKKKIQKAQIIGDQDNIKQVVQSLPGSPAIKKGILQS<br>IKIVDELVKVMGRNPESIVVEMARENQYTNQGKSNSQQRLKRLEESLKELGSKILKENVPVKLSKI<br>DNKALQNERLYLYYLQNGKDMYTGNDLDIDRLSNYDIDHIIPQAFLKDNSIDNKVLVSSASNRGKS<br>DDVPSIDVVKKRKTFWHQLLKSKLISQRKFDNLTKAERGGLTEEDKAGFIHRQLVETRQITKHVAQ<br>LLDSRFNTEKDDNNKAVRTVKIITLKSSLVSQFRKDPKLYKVREINDYHHAHDAYLNAVVATALL<br>KKYPKLAPEFVYGQYEKYEKYKVIDKKSGEISKTKDTSKYGKATAKYFFYSNLMNFFKRVIRYSN<br>GKVIIRPVVEYSKDTGEVAWNKEKDFATVRKVLSCPQVNIVKKTEVQTGGFSKESILPKRNSDKLI<br>ARKKDWDPKKYGGFDSPTVAYSVLVVAKVEKGKSKKLKSVKELLGITIMERSSFEKNPIDFLEAK<br>GYKEVRKDLIVKLPKYSLFELENGRKRMLASAGELQKGNELALPSKYVNFLYLASHYEKLKGSPE<br>DNEQKQLFVEQHKHYLDEIIEQISEFSKRVILADANLDKVLSAYNKHRDKPIREQAENIIHLFTLTNL<br>GAPAAFKYFDTTIDRKRYTSTKEVLDATFIHQSITGLYETRIDLSQLGGD |
| 52 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQDFLDSYNAIFESD<br>LSLENSEQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLAT<br>LKQFVRTNLPEKYDEVFSDQSKDGYAGYIDGKTTQEAFYKYIKNLLSKFEGADYFLDKIEREDFLR<br>KQRTFDNGSIPHQIHLQEMNAIIRRQGEHYPFLKENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEGL<br>RDYQFLDSGQKKQIVNQLFKEKRKVTEKDIIHYLHNVDGYDGIELKGIEKQFNASLSTYHDLLIIK<br>DKEFMDDPKNEEILENVVHTLTIFEDREMIKQRLAQYDSLFDEKVIKALTRRHYTGWGKLSAKLIN<br>GICDKQTGKTILDYLIDDGEINRNFMQLIHDDGLSFKDIIQKAQVVGKTDDVKQVVQELPGSPAIKK<br>GILQSIKIVDELVKVMGHNPENIVVEMARENQFTNQGRRNSQQRYKKIEDAIKNLDSNLNSKILKE<br>YPTNNQALQNDRLFLYYLQNGKDMYTGEELDINQLSNYDIDHIVPQAFIKDDSLDNRVLTSSKDNR<br>GKSDNVPSLEVVQKRKAFWQQLLDSKLISERKENNLTKAERERGGLNELDKVGFIKRQLVETRQIT<br>KHVAQILDARFNTEVNEKGQRIRKVKIITLKSNLVSNFRKEFGLYKVREINDYHHAHDAYLNAVVA |

| SEQ ID NO | Nuclease Sequence |
|---|---|
| | KAILKKYPKLEPEFVYGDYQKYDVKRYISRSKDPKEIEKATEKYFFYSNLLNFFKEEVHYADGTIIK<br>RENIEYSKDTGEIAWNKEKDFATVRKVLSCPQVNIVKKTEVQTGGFSKESILPKRNSDKLIARKKD<br>WDPKKYGGFDSPTVAYSVLVVAKVEKGKSKKLKSVKELLGITIMERSSFEKNPIDFLEAKGYKEVR<br>KDLIVKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDATFIHQSITGLYETRIDLSQLGGD |
| 53 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQDFLDSYNAIFESDL<br>SLENSKQLEEIVKDKISKSAKKDRLLKLFPGEKNSGIFSEFLKLIVGNQADFRKYFNLDEKASLHFSK<br>ESYDEDLETLLGHIGDDYSDVFLKAKKLYDAILLSGILTVTDNETEAPLSSAMIMRYKEHEEDLALL<br>KAYIRKISLETYNEVFKDDTKNGYAGYIDGKTNQEDFYVYLKKLLTGLEGADYFLEKINREDLLRK<br>QRTFDNGSIPYQIHLQEMRAIIDKQAKFYPFLAKNKERIEKILTFRIPYYVGPLARGNSDFAWSIRKR<br>NEKITPWNFEDVIDKESSAEAFINRMTSFDLYLPEEKVLPKHSLLYETFTVYNELTKVRFIAESMRD<br>YQFLDSKQKKDIVRLYFKGKRKVTDKDIIEYLHAIDGYDGIELKGIEKQFNSSLSTYHDLLNIINDKE<br>FLDDSSNEAIIEEIIHTLTIFEDREMIKQRLSKFENIFDKSVLKKLSRRHYTGWGKLSAKLINGIRDEK<br>SGKTILDYLIDDGISNRNFMQLIHDDTLSFKKKIQKKQYIEDQDNIKQVVQSLPGSPAIKKGILQSIKI<br>VDELVKVMGGRKPESIVVEMARENQYTNQGKSNSQQRLKRLEESLKELGSKILKENVPAKLSKID<br>NNALQNERLYLYYLQNGKDMYTGDDLDIDRLSNYDIDHIIPQAFLKDNSIDNKVLVSSASNRGKSD<br>DVPSLDVVKKRKTFWHQLLKSKLISQRKFDNLTKAERGGLTEDDKAGFIKRQLVETRQITKHVAQI<br>LDARFNTKRDDNNKVIRDVKIITLKSSLVSQFRKEFKLYKVREINDYHHAHDAYLNAVVATAILKK<br>YPKLEPEFVYGDYEKHELSDTKGDHKNFDLISKVKSDSSLGKATAKMFFYSNLMNFFKKEVRLAD<br>GTVIVRPVIEYSKDTGEIAWNKEKDFATVRKVLSCPQVNIVKKTEVQTGGFSKESILPKRNSDKLIA<br>RKKDWDPKKYGGFDSPTVAYSVLVVAKVEKGKSKKLKSVKELLGITIMERSSFEKNPIDFLEAKG<br>YKEVRKDLIVKLPKYSLFELENGRKRMLASAGELQKGNELALPSKYVNFLYLASHYEKLKGSPED<br>NEQKQLFVEQHKHYLDEIIEQISEFSKRVILADANLDKVLSAYNKHRDKPIREQAENIIHLFTLTNLG<br>APAAFKYFDTTIDRKRYTSTKEVLDATFIHQSITGLYETRIDLSQLGGD |
| 54 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPEDKRGSKYPIFGNLAKEKTYHDEFP<br>TIYHLRKYLADSQKKADLRLVYLALAHMIKYRGHFLIEGDFNSRNNDIKKNFQEFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>QLKQFVRRNLPEKYAEVFSDQSKDGYAGYIDGKTTQEAFYKYIKNLLTKFEGAEYLLEKIKREDLL<br>RKQRTFDNGSIPYQVHLQEMKAILQHQGEYYPFLKENKEKIQQILTFRIPYYVGPLARGNRDFAWL<br>TRNSDQAIRPWNFEEIVDKASSAEDFINKMTNYDLYLPEEKVLPKHSLLYETFAVYNELTKVKFIAE<br>GLRDYQFLDSGQKKQIVNQLFKEKRKVTEKDIIHYLHNVDGYDGIELKGIEKQFNASLSTYHDLLKI<br>IKDKEFMDDPKNEEILENIVHTLTIFEDREMIKQRLAQYDSLFDEKVIKALIRRHYTGWGKLSAKLI<br>NGIYDKQSKKTILDYLIDDGEINRNFMQLIHDDGLSFKEIIQKAQVFGKTDDVKQVVQELPGSPAIK<br>KGILQSIKIVDELVKVMGHAPESIVIEMARENQTTARGKKNSQQRYKRIEDALKNLAPGLDSNILKE<br>NPTDNIQLQNDRLFLYYLQNGKDMYTGEALDINQLSSYDIDHIIPQAFIKDDSLDNRVLTSSKDNRG<br>KSDNVPSIEVVQKRKAFWQQLLDSKLISERKYNNLTKAERERGGLTELDKAGFIKRQLVETRQITK<br>HVAQILDSRENTEVNDEGKRIRKVKIITLKSNLVSNFRKEFGLYKVREINDYHHAHDAYLNAVVAK<br>AILKKYPKLEPEFVYGDYQKYDIKRYISRSKDPKEIEKATEKYFFYSNLLNFFKEEVHYADGTIIKRE<br>NIEYSKDTGEIAWNKEKDFATVRKVLSCPQVNIVKKTEVQTGGFSKESILPKRNSDKLIARKKDWD<br>PKKYGGFDSPTVAYSVLVVAKVEKGKSKKLKSVKELLGITIMERSSFEKNPIDFLEAKGYKEVRKD<br>LIVKLPKYSLFELENGRKRMLASAGELQKGNELALPSKYVNFLYLASHYEKLKGSPEDNEQKQLFV<br>EQHKHYLDEIIEQISEFSKRVILADANLDKVLSAYNKHRDKPIREQAENIIHLFTLTNLGAPAAFKYF<br>DTTIDRKRYTSTKEVLDATFIHQSITGLYETRIDLSQLGGD |
| 55 | MNKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQDFLDSYNAIFESDL<br>SLENSKQLEEIVKDKISKSAKRERVLSLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLAAL<br>KQFIQNNLQEKYDEVFSDQSKDGYAGYIDGKTTQEAFYKYIKNLLSKLEGADYFLDKIEREDFLRK<br>QRTFDNGSIPHQIHLQEMNAIIHRQGEHYPFLKENREKIEKILTFRIPYYVGPLARGNRDFAWLTRNS<br>DQAIRPWNFEEIVDQASSAEEFINKMTNYDLYLPEEKVLPKHSLLYETFAVYNELTKVKFIAEGLRD<br>YQFLDSGQKKQIVNQLFKEKRKVTEKDIIHFLHNVDGYDGIELKGIEKQFNASLSTYHDLLKIIKDK<br>EFMDDPKNEEILENIVHTLTIFEDREMIKQRLAQYDSLFDEKVIKALTRRHYTGWGKLSAKLINGID<br>KQTGDTILDFLIDDDKINRNFMQLINDDGLSFKDIIQKAQVVGKTDDVKQVVQELPGSPAIKKGIL<br>QSIKIVDELVKVMGHAPESIVIEMARENQTTARGKKNSQQRYKRIEDALKNLAPGLDSNILKEHPT<br>DNIALQNDRLFLYYLQNGKDMYTGEPLDINQLSSYDIDHIVPQAFIKDDSIDNRVLTSSKDNRGKSD<br>NVPSLEVVQKRKAFWQQLLDSKLISERKENNLTKAERGGLDERDKVGFIKRQLVETRQITKHVAQI<br>LDARFNTEVDENGKRIRKVKIVTLKSNLVSNFRKEFGLYKVREINDYHHAHDAYLNAVVAKAILK<br>KYPKLEPEFVYGDYQKYDVKRYISRSKDPKDIEKATQKYFFYSNLLNFFKEEVHYADGTIIKRENIE<br>YSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |

| SEQ ID NO | Nuclease Sequence |
|---|---|
| 56 | MKKSYSIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHMIKFRGHFLIEGQLNAENTDVQTLFNDPFVEVYDKTVE<br>ESHLSEITVDALSILTEKVSKSRRLENLVKCYPTEKKNTLFGNLIALSLGLQPNFKTNFKLSEDAKLQ<br>FSKDTYEEDLEELLGKIGDEYADLFASAKNLYDAILLSGILTVDDNTTKAPLSASMVKRYAEHHED<br>LEKLKEFVKANKPELYHDIFKDETKNGYAGYIENGVKQDEFYKYLKNTLSKIAGSDYFLDKIERED<br>FLRKQRTFDNGSIPHQIHLQEMHAILRRQGEYYPFLKENQAKIEKILTFRIPYYVGPLARKNSRFAW<br>AEYHSDEKITPWNFEEIVDKEESATAFIHRMTNNDLYLPEEKVLPKHSLIYEEFTVYNELTKVKYVT<br>DQGKAYYFDANMKQEIFDGVFKEHRKVTKDKLMNFLEKEFDEFRIVDLTGLDKENKSFNASLGTY<br>HDLKKILDKSFLDDKTNETIIEDIIQTLTLFEDRDMIRQRLQKYSDIFTPQQLKKLERRHYTGWGRLS<br>YKLINGIRNKENGKTILDYLIDDGYANRNFMQLINDDTLPFKQIIQEAQIIGDIDDIETVVHDLPGSPA<br>IKKGILQSVKIVDELVKVMGHNPDNIVIEMARENQTTNRGRSQSQQRLKKLQESLKELGSNILNEEK<br>PSYVEDKVENSHLQNDKLFLYYIQNGKDMYTGEELDIDHLSDYDIDHIIPQAFIKDNSIDNRVLTSS<br>AKNRGKSDDVPSLDIVHDRKADWIRLYKSGLISKRKFDNLTKAEHGGLTEDDKAGFIKRQLVETR<br>QITKHVAQILDSRENTERDENDKVIRDVKVITLKSNLVSQFRKDFELHKVREINDYHHAHDAYLNA<br>VIGNALLVKYPQLEPEFVYGKFKHFHGHKENKATAKKFFYSNIMALFKKDVEYSDDTGEMVWNK<br>EKDFATVRKVLSCPQVNIVKKTEVQTGGFSKESILPKRNSDKLIARKKDWDPKKYGGFDSPTVAYS<br>VLVVAKVEKGKSKKLKSVKELLGITIMERSSFEKNPIDFLEAKGYKEVRKDLIVKLPKYSLFELENG<br>RKRMLASAGELQKGNELALPSKYVNFLYLASHYEKLKGSPEDNEQKQLFVEQHKHYLDEIIEQISE<br>FSKRVILADANLDKVLSAYNKHRDKPIREQAENIIHLFTLTNLGAPAAFKYFDTTIDRKRYTSTKEV<br>LDATFIHQSITGLYETRIDLSQLGGD |
| 57 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKVDESFFQRLDDSFLVPDDKRDSKYPIFGNLVEEKTYHDEF<br>PTIYHLRKYLADSSKKADLRLVYLALAHMIKYRGHFLIEGDFDTRNNNIKIGYIYQKFLDSYNAIFESD<br>LSLENSKQLEEIVKDKISKSAKRERVLKLFPDEKSTGLFSEFLKLIVGNQADFKKHFELEEKAPLQFS<br>KDTYDEDLENLLGQIGDDFADLFLVAKKLYDAILLSGILTVTDPSTKAPLSASMIERYENHQKDLA<br>ALKQFIQNNLQEKYDEVFSDQSKDGYAGYIDGKTTQEAFYKYIKNLLSKLEGADYFLDKIEREDFL<br>RKQRTFDNGSIPHQIHLQEMNAIIRRQGEHYPFLQENKEKIEKILTFRIPYYVGPLARGNRDFAWLTR<br>NSDQAIRPWNFEEVVDKASSAEDFINKMTNYDLYLPEEKVLPKHSLLYETFAVYNELTKVKFIAEG<br>LRDYQFLDSGQKKQIVNQLFKEKRKVTEKDIIHYLHNVDGYDGIELKGIEKQFNASLSTYHDLLKII<br>KDKEFMDDPKNEEILENIVHTLTIFEDREMIKQRLAQYDSLFDEKVIKALTRRHYTGWGKLSAKLIN<br>GIRDKQTNKTILDYLIDDGKINRNFMQLIHDDGLSFKEIIQKAQVVGKTDDVKQVVQELPGSPAIKK<br>GILQSIKIVDELVKVMGHAPESIVIEMARENQTTNQGRRNSQQRYKLIEDGVKNLAKDLDGNILKE<br>YPTDNQALQNDRLFLYYLQNGKDMYTGEALDINQLSNYDIDHIIPQAFIKDDSLDNRVLTSSKDNR<br>GKSDNVPSIEVVQKRKAFWQQLLDSKLISERKENNLTKAERGGLDERDKVGFIKRQLVETRQITKH<br>VAQILDSRFNTEVDETGKRIRKVKIITLKSNLVSNFRKEFGLYKVREINDYHHAHDAYLNAVVAKA<br>ILKKYPKLEPEFVYGDYQKYDIKRYISRSKDPKDIEKATEKYFFYSNLLNFFKEEVHYADGTILKKD<br>SVEYSKDTGEIAWNKKKDFAIVRKVLSCPQVNIVKKTEVQTGGFSKESILPKRNSDKLIARKKDWD<br>PKKYGGFDSPTVAYSVLVVAKVEKGKSKKLKSVKELLGITIMERSSFEKNPIDFLEAKGYKEVRKD<br>LIVKLPKYSLFELENGRKRMLASAGELQKGNELALPSKYVNFLYLASHYEKLKGSPEDNEQKQLFV<br>EQHKHYLDEIIEQISEFSKRVILADANLDKVLSAYNKHRDKPIREQAENIIHLFTLTNLGAPAAFKYF<br>DTTIDRKRYTSTKEVLDATFIHQSITGLYETRIDLSQLGGD |
| 58 | MKKSYSIGLDIGTNSVGWAVVDDDYKVPAKKMRVFGDTDRSHIKKNLLGTLLFDSGETAESRRLK<br>RTARRRYTRRRNRILYLQEIFAEEMNKVDDSFFHRLDESFLTDDDKTFDSHPIFGNKAEEDAYHQK<br>FPTIYHLRKHLADSTEKADLRLVYLALAHMIKFRGHFLIEGELNAENTDVQKLFADPFVGVYDRTFD<br>DSHLSEITVDASSILTEKISKSRRLENLIKHYPTEKKNTLFGNLVALALGLQPNFKTNFKLSEDAKLQ<br>FSKDTYEEDLEELLGKIGDDYADLFTSAKNLYDAILLSGILTVDDESTKAPLSASMIKRYAEHHEDL<br>EKLKEFIKANKPELYHDIFKDETKNGYAGYIENGVKQDEFYKYLKETLSKIAGSDYFLDKIEREDFL<br>RKQRTFDNGSIPHQIHLQEMHAILRRQGDYYPFLKENQAKIEKILTFRIPYYVGPLARKDSRFAWAN<br>YHSDEPITPWNFDEVVDKEKSAEKFITRMTLNDLYLPEEKVLPKHSHVYETYAVYNELTKIKYVNE<br>QGKSFFDANMKQEIFEHVFKENRKVTKEKFLNYLNKEFPEYRIQDLIGLDKENKSFNASLGTYHD<br>LKKILDKSFLDDKENETIIEDIIQTLTLFEDRDMIRQRLQKYSDIFTPQQLKKLERRHYTGWGRLSYK<br>LINGIRNKENNKTILDYLIDDGYANRNFMQLINDDTLPFKQIIQKSQVVGDIDDIKAVVHDLPGSPAI<br>KKGILQSVKIVDELVKVMGHNPDNIVIEMARENQTTNRGRSQSQQRLKKLQDSLKELGSNILNEEK<br>PSYIEDKVENSHLQNDKLFLYYIQNGKDMYTGEELDIDHLSDYDIDHIIPQAFIKDDSIDNRVLTSSA<br>KNRGKSDDVPSLDIVHDRKADWIRLYKSGLISKRKFDNLTKAERGGLTEADKAGFIKRQLVETRQI<br>TKHVAQILDARFNTERDENDKVIRDVKVITLKSNLVSQFRKDFQYKVREINDYHHAHDAYLNAV<br>VGTALLKKYPKLAPEFVYGEYKKYDIRKFITNSSDKATAKYFFYSNLLNFFKTKVRYADGTVIVRP<br>VIEYSKDTGEIAWNKEKDFATVRKVLSCPQVNIVKKTEVQTGGFSKESILPKRNSDKLIARKKDWD<br>PKKYGGFDSPTVAYSVLVVAKVEKGKSKKLKSVKELLGITIMERSSFEKNPIDFLEAKGYKEVRKD<br>LIVKLPKYSLFELENGRKRMLASAGELQKGNELALPSKYVNFLYLASHYEKLKGSPEDNEQKQLFV<br>EQHKHYLDEIIEQISEFSKRVILADANLDKVLSAYNKHRDKPIREQAENIIHLFTLTNLGAPAAFKYF<br>DTTIDRKRYTSTKEVLDATFIHQSITGLYETRIDLSQLGGD |
| 59 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQEFLDSYNAIFESD<br>LSLENSKQLEEIVKDKISKSAKRERVLKLFPDEKSTGLFSEFLKLIVGNQADFKKHFPDLEEKAPLQFS<br>KDTYDEDLENLLGQIGDDFADLFLVAKKLYDAILLSGILTVTDPSTKAPLSASMIERYENHQKDLA<br>ALKQFIKANLPEKYDEVFSDQSKDGYAGYIDGKTTQEAFYKYIKNLLSKFEGADYFLEKIEREDFLR<br>KQRTFDNGSIPHQIHLQEMNAILHRQGDYYPFLKENKEKIQQILTFRIPYYVGPLARGNRDFAWLTR |

| SEQ ID NO | Nuclease Sequence |
|---|---|
| | NSDQAIRPWNFEEVVDKASSAEDFINKMTNYDLYLPEEKVLPKHSLLYETFAVYNELTKVKFIAEG
LRDYQFLDSGQKKQIVNQLFKEKRKVTEKDIIHYLHNVDGYDGIELKGIEKQFNASLSTYHDLLKII
KDKEFMDDPKNEEILENIVHTLTIFEDREMIKQRLAQYDSLFDEKVIKALTRRHYTGWGKLSAKLIN
GICDKQTGDTILDFLIDDDKINRNFMQLINDDGLSFKEIIQKAQVVGKTDDVKQVVQELPGSPAIKK
GILQSIKIVDELVKVMGHAPESIVIEMARENQTTNQGRRNSQQRYKIEEAIKNLDSNLNSKILKEYP
TNNQALQNDRLFLYYLQNGKDMYTGEELDINQLSNYDIDHIVPQAFIKDDSLDNRVLTSSKDNRG
KSDNVPSLEVVQKRKGFWQQLLDSKLISERKENNLTKAERGGLDERDKVGFIKRQLVETRQITKHV
AQILDARFNKEVNDKKQRIRKVKIITLKSNLVSNFRKEFGLYKVREINDYHHAHDAYLNAVVAKAI
LKKYPKLEPEFVYGDYQKYDIKRYISRSKDPKDVEKATEKYFFYSNLLNFFKEEVHYADGTIIKREN
IEYSKDTGEIAWNKEKDFATVRKVLSCPQVNIVKKTEVQTGGFSKESILPKRNSDKLIARKKDWDP
KKYGGFDSPTVAYSVLVVAKVEKGKSKKLKSVKELLGITIMERSSFEKNPIDFLEAKGYKEVRKDL
IVKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 60 | MTKPYSIGLDIGTNSVGWAVITDSYKVPSKKMKVLGNTSKKYVKKNLLGALLFESGITAEGRRLK
RTARRRYTRRRNRILYLQEIFSTEMSKIDESFFQRLDDSFLVPDDKRDSKYPIFGNLAQEKTYHDEFP
TIYHLRKYLADSSKKADLRLVYLALAHMIKYRGHFLIEGDENSKNNDIKKNFQEFLDSYNAIFESDL
SLENSKQLEEIVKDKISKSAKRERVLKLFPDEKSTGLFSEFLKLIVGNQADFKKHFDLEEKAPLQFSK
DTYDEDLENLLGQIGDDFADLFLVAKKLYDAILLSGILTVTDPSTKAPLSASMIERYENHQKDLAAL
KQFIQNNLQEKYDEVFSDQSKDGYAGYIDGKTTQEAFYKYIKNLLSKFEGADYFLEKIEREDFLRK
QRTFDNGTIPYQVHLEEMKAILHRQGDYYPFLKENKEKIQQLLTFRIPYYVGPLARGNRDFAWLTR
NSDQAIRPWNFEEVVDKARSAEDFINKMTNYDLYLPEEKVLPKHSLLYETFAVYNELTKVKFIAEG
LRDYQFLDSGQKKQIVNQLFKEKRKVTEKDIIHYLHTVDGYDGIELKGIEKQFNASLSTYHDLLKII
KDKEFMDDPKNEEILENIVHTLTIFEDREMIKQRLTQYASIFDEKVIKALSRRHYTGWGKLSAKLIN
GIRDKQSRKTILDYLIDDGEINRNFMQLIHDDGLSFKDIIQKAQVVGKTDDVKQVVQELPGSPAIKK
GILQSIKLVDELVKVMGHAPESIVIEMARENQTTARGKKNSQQRYKRIEDALKNLAPGLDSNILKE
HPTDNIQLQNDRLFLYYLQNGKDMYTGKSLDINQLSNYDIDHIVPQAFIKDDSLDNRVLTSSKDNR
GKSDNVPSLEVVQKRKAFWQQLLDSKLISERKENNLTKAERGGLDERDKVGFIKRQLVETRQITKH
VAQILDARFNTEVNEKNQKIRKVKIVTLKSNLVSNFRKEFGLYKVREINDYHHAHDAYLNAVVAK
AILKKYPKLEPEFVYGDYQKYDVKRYISRSKDPKDIEKATEKYFFYSNLLNFFKEEVHYADGTIIKR
ENIEYSKDTGEIAWNKEKDFATVRKVLSCPQVNIVKKTEVQTGGFSKESILPKRNSDKLIARKKDW
DPKKYGGFDSPTVAYSVLVVAKVEKGKSKKLKSVKELLGITIMERSSFEKNPIDFLEAKGYKEVRK
DLIVKLPKYSLFELENGRKRMLASAGELQKGNELALPSKYVNFLYLASHYEKLKGSPEDNEQKQLF
VEQHKHYLDEIIEQISEFSKRVILADANLDKVLSAYNKHRDKPIREQAENIIHLFTLTNLGAPAAFKY
FDTTIDRKRYTSTKEVLDATFIHQSITGLYETRIDLSQLGGD |
| 61 | MNKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKVYHDEF
PTIYHLRKYLADSSKKADLRLVYLALAHMIKYRGHFLIEGDFNSRNNDIKKNFQDFLDSYNAIFESD
LSLENSAQVEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLSA
LKQFIRRNIPEKYDEVFSDQSKDGYAGYIDGKTTQEAFYKYIKNTLSKIEGADYFLDKIEREDFLRK
QRTFDNGSIPHQIHLQEMNAILHHQGEYYPFLQENKEKIEKILTFRIPYYVGPLARGNRDFAWLTRN
SDQAIRPWNFEEVVDKASSAEDFINKMTNYDLYLPEEKVLPKHSLLYETFAVYNELTKVKFIAEGL
RDYQFLDSGQKKQIVNQLFKEKRKVTEKDIIHFLHNVDGYDGIELKGIEKQFNASLSTYHDLLKIIK
DKEFMDDPKNEEILENIVHTLTIFEDREMIKQRLAQYDSLFDEKVIKALTRRHYTGWGKLSAKLING
ICDKQTGDTILDFLIDDDKINRNFMQLINDDGLSFKDIIQKAQVVGKTDDVKQVVQELPGSPAIKKG
ILQSIKLVDELVKVMGHAPESIVIEMARENQTTARGKKNSQQRYKRIEDALKNLAPGLDSNILKENP
TDNIQLQNDRLFLYYLQNGKDMYTGEALDINQLSNYDIDHIVPQAFIKDDSLDNRVLTSSKDNRG
SDNVPSLEVVQKRKAFWQQLLDSKLISEHKFNNLTKAERGGLDERDKVGFIRRQLVETRQITKHVA
QILDARFNTEVNEKNQKIRKVKIITLKSNLVSNFRKEFGLYKVREINDYHHAHDAYLNAVVAKAIL
KKYPKLEPEFVYGDYQKYDLKKYIPKSKSHGTIEKATQKYFFYSNLLNFFKEEVHYADGTIIKRENI
EYSKDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 62 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVKEKTYHDEF
PTIYHLRKYLADSSKKADLRLVYLALAHMIKYRGHFLIEGDFNSRNNDIKKNFQNFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLA
QLKQFVKTNLPEKYDEVFSDQSKDGYAGYIDGKTTEEAFYKYIKNILNNVKGADYFLDKIEREDFL
RKQRTFDNGSIPHQIHLQEMNAILRRQGEHYPFLKENKEKIEKILTFRIPYYVGPLARGNRDFAWLT
RNSDQAIRPWNFEEIVDQASSAEDFINKMTNYDLYLPEEKVLPKHSLLYETFAVYNELTKVKFIAEG
LRDYQFLDSGQKKQIVNQLFKEKRKVTEKDIIHYLHNVDGYDGIELKGIEKQFNASLSTYHDLLKII
KDKEFMDDPKNEEILENIVHTLTIFEDREMIKQRLAQYDSLFDEKVIKALTRRHYTGWGKLSAKLIN
GICDKQTGDTILDFLIDDDKINRNFMQLINDDGLSFKEIIQKAQVVGENDNLKQVVQNLPGSPAIKK
GILQSIKIVDELVKVMGGDPEHIVVEMARENQFTNQGRRNSQQRYKIENAIKNLDSSLNSKILKEY
PTNNQALQNDRLFLYYLQNGKDMYTGEPLDINQLSNYDIDHIVPQAFIKDDSLDNRVLTSSKDNRG
KSDNVPSIEIVEKMKGFWQQLLDSKLISERKENNLTKAERGGLDERDKVGFIKRQLVETRQITKHV
AQILDARFNTEVDENNQKIRTVKIITLKSNLVSNFRKEFGLYKVREINDYHHAHDAYLNAVVAKAI |

| SEQ ID NO | Nuclease Sequence |
|---|---|
| | LKKYPKLEPEFVYGDYQKYDLKRYLSKSGNPKAIDKATQKYFFYSNLLNFFKEEVHYADGTIVKR<br>ENIEYSKDTGEIAWNKEKDFATVRKVLSCPQVNIVKKTEVQTGGFSKESILPKRNSDKLIARKKDW<br>DPKKYGGFDSPTVAYSVLVVAKVEKGKSKKLKSVKELLGITIMERSSFEKNPIDFLEAKGYKEVRK<br>DLIVKLPKYSLFELENGRKRMLASAGELQKGNELALPSKYVNFLYLASHYEKLKGSPEDNEQKLF<br>VEQHKHYLDEIIEQISEFSKRVILADANLDKVLSAYNKHRDKPIREQAENIIHLFTLTNLGAPAAFKY<br>FDTTIDRKRYTSTKEVLDATFIHQSITGLYETRIDLSQLGGD |
| 63 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQEFLDSYNAIFESDL<br>SLENSAQVEEIVKDKISKSAKRERVLKLFPDEKSTGLFSEFLKLIVGNQADFKKHFDLEEKAPLQFS<br>KDTYDEDLENLLGQIGDGFADLFLVAKKLYDAILLSGILTVTDPSTKAPLSASMIERYENHQKDLA<br>ALKQFVKANLPEKYDEVFSDQSKDGYAGYIDGKTTQEAFYKYIKNLLSKLEGADYFLDKIEREDFL<br>RKQRTFDNGSIPHQIHLQEMNAILRRQGEYYPFLKENKEKIEKILTFRIPYYVGPLARGNRDFAWLT<br>RNSDQAIRPWNFEEVVDQASSAEDFINKMTNYDLYLPEEKVLPKHSLLYETFAVYNELTKVKFIAE<br>GLRDYQFLDSGQKKQIVNQLFKEKRKVTEKDIIHFLHNVDGYDGIELKGIEKQFNASLSTYHDLLKI<br>IKDKEFMDDPKNEEILENIVHTLTIFEDREMIKQRLAQYDSLFDEKVIKALARRHYTGWGKLSAKLI<br>NGIHDKQSQKTILDYLIDDDKINRNFMQLINDDGLSFKDIIQKAQVVGKTDDVKQVVQELPGSPAIK<br>KGILQSIKIVDELVKVMGHAPESIVIEMARENQTTARGKKNSQQRYKRIEDAIKGLSSDLNHKILKE<br>HPTDNQALQNDRLFYYLQNGKDMYTGEELDINQLSNYDIDHIIPQAFIKDDSLDNRVLTSSKDNR<br>GKSDNVPSIEVVQKRKAFWQQLLDSKLISERKENNLTKAERGGLDEKDKVGFIRRQLVETRQITKH<br>VAQILDARFNTEVDDKGKRIRKVKIVTLKSNLVSNFRKEFGLYKVREINDYHHAHDAYLNAVVAK<br>AILKKYPKLEPEFVYGDYQKYDVKRYISRSKEPKDIEKATEKYFFYSNLLNFFKEEVHYADGTIIKR<br>ENIEYSNDTGEIAWNKEKDFATVRKVLSCPQVNIVKKTEVQTGGFSKESILPKRNSDKLIARKKDW<br>DPKKYGGFDSPTVAYSVLVVAKVEKGKSKKLKSVKELLGITIMERSSFEKNPIDFLEAKGYKEVRK<br>DLIVKLPKYSLFELENGRKRMLASAGELQKGNELALPSKYVNFLYLASHYEKLKGSPEDNEQKLF<br>VEQHKHYLDEIIEQISEFSKRVILADANLDKVLSAYNKHRDKPIREQAENIIHLFTLTNLGAPAAFKY<br>FDTTIDRKRYTSTKEVLDATFIHQSITGLYETRIDLSQLGGD |
| 64 | MTKPYSIGLDIGTNSVGWAVITDSYKVPSKKMKVLGNTSKKYVKKNLLGALLFESGITAEGRRLK<br>RTARRRYTRRRNRILYLQEIFSTEMNKIDDAFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKKDRLLKLFPGEKNSGIFSEFLKLIVGNQADFRKYFNLDEKASLHES<br>KESYDEDLETLLGHIGDDYSDVFLKAKKLYDAILLSGILTVTDNETEAPLSSAMIMRYKEHEEDLAL<br>LKAYIRKISLETYNEVFKDDTKNGYAGYIDGKTNQEDFYVYLKKLLTGLEGADYFLEKINREDLLR<br>KQRTFDNGSIPYQIHLQEMRAIIDKQAKFYPPLAKNKERIEKILTFRIPYYVGPLARGNSDFAWSIRK<br>RNEKITPWNFEDVIDKESSAEAFINRMTSFDLYLPEEKVLPKHSLLYETFTVYNELTKVRFIAESMR<br>DYQFLDSKQKKDIVRLYFKGKRKVTDKDIIEYLHAIDGYDGIELKGIEKQFNSSLATYHDLLNIIND<br>KEFLDDSSNEAIIEEIIHTLTIFEDREMIKQRLSKFENIFDKSVLKKLSRRHYTGWGKLSAKLINGIRD<br>EKSGKTILDYLIDDGISNRNFMQLIHDDTLSFKKKIQKAQIIGDQDNIKQVVQSLPGSPAIKKGILQSI<br>KIVDELVKVMGRNPESIVVEMARENQYTNQGKSNSQQRLKRLEESLKELGSKILKENVPAKLSKID<br>NNALQNERLYLYYLQNGKDMYTGKDLDIDRLSNYDIDHIIPQAFLKDNSIDNKVLVSSASNRGKSD<br>DVPSLEVVKKRKTFWHQLLKSKLISQRKFDNLTKAERGGLTENDKAGFIKRQLVETRQITKHVAQI<br>LDARFNTEKDDNNKAIREVKIITLKSSLVSQFRKDFQLYKVREINDYHHAHDAYLNAVVATAILKK<br>YPKLEPEFVYGEYKKYDVRKFVAKDDKSLGKATAKMFFYSNLMNFFKKEVRFADGTVIVRPLIEY<br>SKDTGEIAWNKEKDFATVRKVLSCPQVNIVKKTEVQTGGFSKESILPKRNSDKLIARKKDWDPKK<br>YGGFDSPTVAYSVLVVAKVEKGKSKKLKSVKELLGITIMERSSFEKNPIDFLEAKGYKEVRKDLIV<br>KLPKYSLFELENGRKRMLASAGELQKGNELALPSKYVNFLYLASHYEKLKGSPEDNEQKQLFVEQ<br>HKHYLDEIIEQISEFSKRVILADANLDKVLSAYNKHRDKPIREQAENIIHLFTLTNLGAPAAFKYFDT<br>TIDRKRYTSTKEVLDATFIHQSITGLYETRIDLSQLGGD |
| 65 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKKDRLLKLFPGEKNSGIFSEFLKLIVGNQADFRKYFNLDEKASLHES<br>KESYDEDLETLLGHIGDDYSDVFLKAKKLYDAILLSGILTVTDNETEAPLSSAMIMRYKEHEEDLAL<br>LKAYIRKISLETYNEVFKDDTKNGYAGYIDGKTNQEDFYVYLKKLLTGLEGADYFLEKINREDLLR<br>KQRTFDNGSIPYQIHLQEMRAIIDKQAKFYPPLAKNKERIEKILTFRIPYYVGPLARGNSDFAWSIRK<br>RNEKITPWNFEDVIDKESSAEAFINRMTSFDLYLPEEKVLPKHSLLYETFTVYNELTKVRFIAESMR<br>DYQFLDSKQKKDIVRLYFKGKRKVTDKDIIDYLHAIDGYDGIELKGIEKQFNSSLSTYHDLLNIIND<br>KEFLDDSSNEAIIEEIIHTLTIFEDREMIKQRLSKFENIFDKSVLKKLSRRHYTGWGKLSAKLINGIRD<br>EKSGKTILDYLIDDGISNRNFMQLIHDDTLSFKKKIQKEQYIEDQDNIKQVVQSLPGSPAIKKGILQSI<br>KIVDELVKVMGGRKPESIVVEMARENQYTNQGKSNSQQRLKRLEESLKELGSKILKENVPAKLSKI<br>DNNALQNERLYLYYLQNGKDMYTGEDLDIDRLSNYDIDHIIPQAFLKDNSIDNKVLVSSASNRGKS<br>DDVPSLDVVKKRKGFWHQLLKSQLISQRKFDNLTKAERGGLTEDDKAGFIKRQLVETRQITKHVA<br>QILDARFNTEPDENGKRIRKVKIITLKSSLVSQFRKEFGLYKVREINDYHHAHDAYLNAVVATAILK<br>KYPKLEPEFVYGDYQKYDIRKYLSTKDNKDLGKATAKMFFYSNLMNFFKKEVRLSDGTVVVRPVI<br>EYSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |

| SEQ ID NO | Nuclease Sequence |
|---|---|
| 66 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVKEKTYHDEF
PTIYHLRKYLADSSKKADLRLVYLALAHMIKYRGHFLIEGDFNSRNNDIKKNFQEFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLA
ALKQFVRANLPEKYDEVFSDQSKDGYAGYIDKTTQEAFYKYIKNLLSKFEGADYFLDKIEREDFL
RKQRTFDNGSIPHQIHLQEMNAIIRRQGEYYPFLKENKEKIEKILTFRIPYYVGPLARGNRDFAWLTR
NSDQAIRPWNFEEVVDQASSAEDFINKMTNYDLYLPEEKVLPKHSLLYETFAVYNELTKVKFIAEG
LRDYQFLDSGQKKQIVNQLFKEKRKVTEKDIIHYLHNVDGYDGIELKGIEKQFNASLSTYHDLLKII
KDKDFMDDPKNEEILENIVHTLTIFEDREMIKQRLAQYDSLFDEKVIKALTRRHYTGWGKLSAKLI
NGIRDKKSGKTILDYLIDDDKINRNFMQLIHDDGLSFKEIIQKAQVVGKTDDLKQVVQELPGSPAIK
KGILQSIKIVDELVKVMGHAPESIVIEMARENQTTNQGRRNSQQRYKLIEDGVKNLASELDGNILKE
YPTDNQALQNDRLFLYYLQNGKDMYTGEPLDINHLSDYDIDHIVPQAFIKDDSIDNRVLTSSKDNR
GKSDNVPSLEIVEKMKGFWQQLLDSKLISERKENNLTKAERGGLDERDKVGFIKRQLVETRQITKH
VAQILDARFNTEVEKNQKIRSVKIVTLKSNLVSNFRKEFGLYKVREINDYHHAHDAYLNAVVAK
AILKKYPKLEPEFVYGDYQKYDIKRYISRSKDPKDIEKATEKYFFYSNLLNFFKEEVHYADGTIIKRE
NIEYSKDTGEIAWNKEKDFATVRKVLSCPQVNIVKKTEVQTGGFSKESILPKRNSDKLIARKKDWD
PKKYGGFDSPTVAYSVLVVAKVEKGKSKKLKSVKELLGITIMERSSFEKNPIDFLEAKGYKEVRKD
LIVKLPKYSLFELENGRKRMLASAGELQKGNELALPSKYVNFLYLASHYEKLKGSPEDNEQKQLFV
EQHKHYLDEIIEQISEFSKRVILADANLDKVLSAYNKHRDKPIREQAENIIHLFTLTNLGAPAAFKYF
DTTIDRKRYTSTKEVLDATFIHQSITGLYETRIDLSQLGGD |
| 67 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKTYHDEFP
TIYHLRKYLADSSKKADLRLVYLALAHMIKYRGHFLIEGEFNSKNNDIKKNFQEFLDSYNAIFESDL
SLENNAQVEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLA
ALKQFIRTNLPEKYDEVFSDDSKDGYAGYIDKTTQEEFYKYIKNLLSKLEGADYFLEKIEREDFLR
KQRTFDNGSIPHQIHLQEMNAILRRQGEYYPFLQENKEKIEKILTFRIPYYVGPLARGNRDFAWLTR
NSDQAIRPWNFEEIVDKASSAEDFINKMTNYDLYLPEEKVLPKHSLLYETFAVYNELTKVKFIAEGL
RDYQFLDSGQKKQIVNQLFKEKRKVTEKDIIQFLHNVDGYDGIELKGIEKQFNASLSTYHDLLKIIK
DKEFMDDPKNEEILENIVHTLTIFEDREMIKQRLAQYDSLFDEKVIKALTRRHYTGWGKLSAKLING
ICDKQTGNTILDYLIDDDKINRNFMQLIHDDGLSFKEIIQKAQVVGKTDDVKQVVQELPGSPAIKKG
ILQSIKIVDELVKVMGHEPEQIVVEMARENQTTNQGRRNSRQRYKLLDDGVKNLASDLNGNILKE
YPTDNQALQNDRLFLYYLQNGKDMYTGEPLDINQLSSYDIDHIIPQAFIKDDSLDNRVLTSSKDNR
GKSDNVPSLEIVEKMKGFWQQLLDSKLISERKYNNLTKAERERGGLNELDKVGFIKRQLVETRQIT
KHVAQILDARFNTEVNDKKQKIRKVKIITLKSNLVSNFRKEFGLYKVREINDYHHAHDAYLNAVV
AKAILKKYPKLEPEFVYGDYQKYDIKRYISRSKDPKDIEKATEKYFFYSNLLNFFKEEVHYADGTII
KRENIEYSKDTGEIAWNKEKDFATVRKVLSCPQVNIVKKTEVQTGGFSKESILPKRNSDKLIARKK
DWDPKKYGGFDSPTVAYSVLVVAKVEKGKSKKLKSVKELLGITIMERSSFEKNPIDFLEAKGYKEV
RKDLIVKLPKYSLFELENGRKRMLASAGELQKGNELALPSKYVNFLYLASHYEKLKGSPEDNEQ
QLFVEQHKHYLDEIIEQISEFSKRVILADANLDKVLSAYNKHRDKPIREQAENIIHLFTLTNLGAPAA
FKYFDTTIDRKRYTSTKEVLDATFIHQSITGLYETRIDLSQLGGD |
| 68 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKTYHDEFP
TIYHLRKYLADSSKKADLRLVYLALAHMIKYRGHFLIEGDFNSRNNDIKKNFQDFLDSYNAIFESDL
SLENSKQLEEIVKDKISKSAKRERVLKLFPDEKSTGLFSEFLKLIVGNQADFKKHFDLEEKAPLQFSK
DTYDEDLENLLGQIGDDFADLFLVAKKLYDAILLSGILTVTDPSTKAPLSASMIERYENHQKDLAAL
KQFIQNNLQEKYDEVFSDQSKDGYAGYIDKTTQEAFYKYIKNLLSKFEGADYFLEKIEREDFLRK
QRTFDNGSIPHQIHLQEMNAILRRQGEYYPFLKENKEKIEKILTFRIPYYVGPLARGNRDFAWLTRN
SDQAIRPWNFEEIVDQASSAEDFINKMTNYDLYLPEEKVLPKHSLLYETFAVYNELTKVKFIAEGLR
DYQFLDSGQKKQIVTQLFKEKRKVTEKDIIQFLHNVDGYDGIELKGIEKQFNASLSTYHDLLKIID
KEFMDDPKNEEILENIVHTLTIFEDREMIKQRLAQYDSLFDEKVIKALTRRHYTGWGKLSAKLINGI
CDKQTGDTILDYLIDDDKINRNFMQLINDDGLSFKEIIQKAQVVGKTDDVKQVVQELPGSPAIKKGI
LQSIKIVDELVKVMGHEPESIVIEMARENQTTNQGKRNSQQRYKRLEDGVKNLASDLNGNILKEYP
TDNQALQNDRLFLYYLQNGKDMYTGEPLDINQLSSYDIDHIIPQAFIKDDSLDNRVLTSSKDNRGK
SDNVPSIEVVQKRKGFWQQLLDSKLISERKENNLTKAERGGLDERDKVGFIKRQLVETRQITKHVA
QILDSRFNTEVDESGKRIRKVKIITLKSNLVSNFRKEFGLYKVREINDYHHAHDAYLNAVVAKAILK
KYPKLEPEFVYGDYQKYDVRKYLSTKDDKDFGKATAKLFFYSNLMNFFKKEVRFADGTIIVRPVIE
YSKDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 69 | MNKPYSIGLDIGTNSVGWSVITDDYKVPSKKMKVLGNTDKKYIKKNLLGALLFEGGETAEGRRLK
RTARRRYTRRRNRILYLQEIFSTEMSKIDESFFQRLDDSFLVPDDKRDSKYPIFANLAQEKTYHDKFP
TIYHLRKYLADSSKKADLRLVYLALAHMIKYRGHFLIEGDFNSRNNDIKKNFQNFLDSYNAIFESDL
SLENSAQVEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLA
ALKQFIKTNLPEKYDEVFSDQSKDGYAGYIDKTTQEAFYKYIKNTLNNVKGADYFLDKIEREDFL
RKQRTFDNGSIPHQIHLQEMNAIIRRQGEHYPFLKENREKIEKILTFRIPYYVGPLARGNRDFAWLTR |

| SEQ ID NO | Nuclease Sequence |
|---|---|
| | NSDQAIRPWNFEEVVDKASSAEEFINKMTNYDLYLPEEKVLPKHSLLYETFAVYNELTKVKFIAEG
LRDYQFLDSGQKKQIVNQLFKEKRKVTEKDIIHYLHNVDGYDGIELKGIEKQFNASLSTYHDLLKII
KDKEFMDDPKNEEILENIVHTLTIFEDREMIKQRLAQYDTLFDEKVIKALTRRHYTGWGKLSAKLI
NGICDKQTGETILDFLIDDDKINRNFMQLINDDGLSFKEIIQKAQVVGKTDDVKQVVQELPGSPAIK
KGILQSIKIVDELVKVMGHDPESIVIEMARENQTTNQGRRNSQQRYKKIEEAIKNLDSNLNSKILKE
YPTDNQALQNDRLFLYYLQNGKDMYTDEELDINQLSNYDIDHIVPQAFIKDDSIDNRVLTSSKDNR
GKSDNVPSLEVVQKRKAFWQQLLDSKLISERKENNLTKAERGGLDERDKVGFIKRQLVETRQITKH
VAQILDSRENTEVDENGKRIRKVKIITLKSNLVSNFRKEFGLYKVREINDYHHAHDAYLNAVVAKA
ILKKYPKLEPEFVYGDYQKYDIKRYISRSKDPKDIEKATEKYFFYSNLLNFFKEEVHYADGTIIKREN
IEYSKDTGEVAWNKEKDFATVRKVLSCPQVNIVKKTEVQTGGFSKESILPKRNSDKLIARKKDWDP
KKYGGFDSPTVAYSVLVVAKVEKGKSKKLKSVKELLGITIMERSSFEKNPIDFLEAKGYKEVRKDL
IVKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 70 | MTKPYSIGLDIGTNSVGWAVITDDYKVPSKKMKVLGNTSKKYVKKNLLGALLFESGITAEGRRLK
RTARRRYTRRRNRILYLQEIFATEMAKVDESFFQRLDDSFLVPDDKRDSKYPIFGNLVEEKTYHDEF
PTIYHLRKYLADSSKKADLRLVYLALAHMIKYRGHFLIEGDFNSRNNDIKKNFQNFLDSYNAIFESD
LSLENSAQVEEIVKDKISKSAKRERVLKLFPDEKSTGLFSEFLKLIVGNQAEFKKHFDLEEKAPLQFS
KDTYDEDLENLLGQIGDDFADLFLVAKKLYDAILLSGILTVTDPSTKAPLSASMIERYENHQKDLA
ALKQFVKANLPEKYDEVFSDQSKDGYAGYIDKTTQEAFYKYIKNLLSKFEGADYFLEKIEREDFL
RKQRTFDNGSIPHQIHLQEMNAILRRQGEYYPFLKENREKIEKILTFRIPYYVGPLARGNRDFAWLT
RNSDQAIRPWNFEEIVDQASSAEDFINKMTNYDLYLPEEKVLPKHSLLYETFAVYNELTKVKFIAEG
LRDYQFLDSGQKKQIVNQLFKEKRKVTEKDIIHYLHNVDGYDGIELKGIEKQFNASLSTYHDLLKII
KDKEFMDDPKNEEILENIVHTLTIFEDREMIKQRLAQYDTLFDEKVIKALTRRHYTGWGKLSAKLI
NGISDKQTGDTILDFLIDDDKINRNFMQLINDDGLSFKEIIQKAQVVGKTDDLKQVVQELPGSPAIK
KGILQSIKIVDELVKVMGHAPESIVIEMARENQTTNQGRRNSRQRYKLIEDGVKNLASDLNGNILKE
YPTDNQALQNDRLFLYYLQNGKDMYTGEALDINQLSNYDIDHIVPQAFIKDDSLDNRVLTSSKDN
RGKSDNVPSLEVVEKMKGFWQQLLDSKLISERKENNLTKAERGGLDERDKVGFIKRQLVETRQIT
KHVAQILDARFNTEVNEKGQKIRKVKIITLKSNLVSNFRKEFGLYKVREINDYHHAHDAYLNAVV
AKAILKKYPKLEPEFVYGDYQKYDIKRYISRSKDPKEIEKATEKYFFYSNLLNFFKEEVYYADGTII
KRDSVEYSNDTGEIAWNKEKDFATVRKVLSCPQVNIVKKTEVQTGGFSKESILPKRNSDKLIARKK
DWDPKKYGGFDSPTVAYSVLVVAKVEKGKSKKLKSVKELLGITIMERSSFEKNPIDFLEAKGYKEV
RKDLIVKLPKYSLFELENGRKRMLASAGELQKGNELALPSKYVNFLYLASHYEKLKGSPEDNEQK
QLFVEQHKHYLDEIIEQISEFSKRVILADANLDKVLSAYNKHRDKPIREQAENIIHLFTLTNLGAPAA
FKYFDTTIDRKRYTSTKEVLDATFIHQSITGLYETRIDLSQLGGD |
| 71 | MKKPYSIGLDIGTNSVGWAVVTDDYKVPAKKMKVLGNTDKSHIKKNLLGALLFDSGNTAEDRRL
KRTARRRYTRRRNRILYLQEIFAEEMNKVDESFFHRLDDSFLVPEDKRGSKYPIFATLEEEKEYHKK
FPTIYHLRKHLADSKEKTDLRLIYLALAHMIKYRGHFLYEESFDIKNNDIQKIFNEFISIYDNTFEGSS
LSGQNAQVEEIFTDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLA
ALKQFIKNNLSEKYDEVFSDQSKDGYAGYIEGKTTQEAFYKYIKKAIEKIEGSDYFLDKIERENFLR
KQRTFDNGSIPHQIHLQEMHAIIHRQGEYYPFLKENKEKIEKILTFRIPYYVGPLARGKSDFAWLTRK
SDDAIRPWNFEEMVDKESSAEAFIHRMTNYDLYLPEEKVLPKHSLLYEKFAVYNELTKVRYVTEQ
GKSFFFDANMKQEIFDGIFKKYRKVTKEKLMDFLAGKEFDEFFVDLMGLDKDNKSFNASLGTYHD
LKKIVSKDFLDNPENEDILENVVLTLTLFEDREMIRKRLEKYKDVLTEEQRKKLERRHYTGWGRLS
AKLINGIRDKVTRKTILDYLIDDGTSNRNFMQLIHDDTLSFVDEIRLAQGSGEAEDYREEVQNLAGS
PAIKKGILQSLKIVDELVGVMGYDPEHIVVEMARENQFTNQGRRNSQQRYKKIKDAIKNLDSNLNS
KILKEYPTDNQALQNDRLFLYYLQNGKDMYTGEALDINQLSNYDIDHIIPQAFIKDDSLDNRVLTSS
KDNRGKSDNVPSIEVVEKMKAFWQQLLDSKLISERKYNNLTKAERERGGLNELDKVGFIKRQLVE
TRQITKHVAQILDARFNTEVDEKGKRIRKVKIITLKSNLVSNFRKEFGLYKVREINDYHHAHDAYL
NAVVAKAILKKYPKLEPEFVYGDYQKYDIKRYISRSKDPKDIEKATEKYFFYSNLLNFFKEEVHYA
DGTIVKRENIEYSKDTGEIAWNKEKDFATVRKVLSCPQVNIVKKTEVQTGGFSKESILPKRNSDKLI
ARKKDWDPKKYGGFDSPTVAYSVLVVAKVEKGKSKKLKSVKELLGITIMERSSFEKNPIDFLEAK
GYKEVRKDLIVKLPKYSLFELENGRKRMLASAGELQKGNELALPSKYVNFLYLASHYEKLKGSPE
DNEQKQLFVEQHKHYLDEIIEQISEFSKRVILADANLDKVLSAYNKHRDKPIREQAENIIHLFTLTNL
GAPAAFKYFDTTIDRKRYTSTKEVLDATFIHQSITGLYETRIDLSQLGGD |
| 72 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKTYHDEFP
TIYHLRKYLADSSKKADLRLVYLALAHMIKYRGHFLIEGDFNSRNNDIKKNFQDFLDSYNAIFESDL
SLENSKQLEEIVKDKISKSAKKDRLLKLFPGEKNSGIFSEFLKLIVGNQADFRKYFNLDEKASLHFSK
ESYDEDLETLLGHIGDDYSDVFLKAKKLYDAILLSGILTVTDNETEAPLSSAMIMRYKEHEEDLALL
KAYIRKISLETYNEVFKDDTKNGYAGYIDKTTNQEDFYVYLKKLLTGLEGADYFLEKINREDLLRK
QRTFDNGSIPYQIHLQEMRAIIDKQAKFYPPLAKNKERIEKILTFRIPYYVGPLARGNSDFAWSIRKR
NEKITPWNFEDVIDKESSAEAFINRMTSFDLYLPEEKVLPKHSLLYETFTVYNELTKVRFIAESMRD
YQFLDSKQKKDIVRLYFKGKRKVTDKDIIDYLHAIDGYDGIELKGIEKQFNSSLSTYHDLLKIIKDKE
FLDDASNEAIIEEIIHTLTIFEDREMIKQRLSKFENIFDKSVLKKLSRRHYTGWGKLSAKLINGIRDEK
SGKTILDYLIDDGVSNRNFMQLIHDDTLSFKKKIQKAQIIGDQDNIKQVVQSLPGSPAIKKGILQSIKI
VDELVKVMGRNPESIVVEMARENQYTNQGKSNSQQRLKRLEESLKELGSKILKENVPAKLSKIDN
NALQNERLYLYYLQNGKDMYTGDDLDIDRLSNYDIDHIIPQAFLKDNSIDNKVLVSSASNRGKSDD
VPSLDVVKKRKTFWHQLLKSQLISQRKFDNLTKAERGGLTEKDKAGFIKRQLVETRQITKHVAQIL
DSRFNTKRDDNDKVIRNVKIITLKSSLVSQFRKEFGLYKVREINDYHHAHDAYLNAVVATAILKKY |

| SEQ ID NO | Nuclease Sequence |
|---|---|
| | PKLEPEFVYGDYKTYTYDELKQGDLRQIKRADIDKSLGKATAKMFFYSNLMNFFKKEVRLADGTV<br>IVRPVIEYSKDTGEIAWNKEKDFATVRKVLSCPQVNIVKKTEVQTGGFSKESILPKRNSDKLIARKK<br>DWDPKKYGGFDSPTVAYSVLVVAKVEGKSKKLKSVKELLGITIMERSSFEKNPIDFLEAKGYKEV<br>RKDLIVKLPKYSLFELENGRKRMLASAGELQKGNELALPSKYVNFLYLASHYEKLKGSPEDNEQK<br>QLFVEQHKHYLDEIIEQISEFSKRVILADANLDKVLSAYNKHRDKPIREQAENIIHLFTLTNLGAPAA<br>FKYFDTTIDRKRYTSTKEVLDATFIHQSITGLYETRIDLSQLGGD |
| 73 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKVYHDEF<br>PTIYHLRKYLADSSKKADLRLVYLALAHMIKYRGHFLIEGEFNSKNNDIKKNFQEFLDSYNAIFESD<br>LSLENSKQLEEIVKDKISKSAKRERVLKLFPDEKSTGLFSEFLKIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIKTNLPEKYDEVFSDQSKDGYAGYIDGKTTQEAFYKYIKNLLSKFEGADYFLDKIEREDFLR<br>KQRTFDNGSIPHQIHLQEMNAIIRRQGEHYPPFLKENKEKIEKILTFRIPYYVGPLARGNRDFAWLTR<br>NSDQAIRPWNFEEIVDKASSAEDFINKMTNYDLYLPEEKVLPKHSLLYETFAVYNELTKVKFIAEDL<br>TRYQFLDKKQKKDIFDTFFKAEDKRKVTEKDIIHYLHNVDGYDGIELKGIEKQFNASLSTYHDLLKI<br>IKDKEFMDDAKNEEILENIIHTLTIFEDREMIKQRLAQYDSLFDEKVIKALTRRHYTGWGKLSAKLI<br>NGIRDKKSGKTILDYLIDDGEINRNFMQLIHDDGLSFKEIIQKAQVFGKTDDIKQVVQNLPGSPAIKK<br>GILQSIKIVDELVKVMGKDPEHIVVEMARENQFTNQGRRNSQQRYKKIKDAIKNLDSNLNSKILKE<br>YPTNNQALQNDRLFLYYLQNGKDMYTGEPLEINQLSNYDIDHIIPQAFIKDDSLDNRVLTSSKDNR<br>GKSDNVPSIEVVEKMKGFWKQLLDSKLISERKYNNLTKAERERDGLNELDKVGFIKRQLVETRQIT<br>KHVAQILDARFNTEVNEKNQKIRNVKIITLKSNLVSNFRKEFGLYKVREINDYHHAHDAYLNAVV<br>AKAILKKYPKLEPEFVYGDYQKYDLKRYISRSKDPKEIEKATQKYFFYSNLLNFFKEEVHYADGTI<br>VKRENIEYSKDTGEIAWNKEKDFATVRKVLSCPQVNIVKKTEVQTGGFSKESILPKRNSDKLIARK<br>KDWDPKKYGGFDSPTVAYSVLVVAKVEGKSKKLKSVKELLGITIMERSSFEKNPIDFLEAKGYKE<br>VRKDLIVKLPKYSLFELENGRKRMLASAGELQKGNELALPSKYVNFLYLASHYEKLKGSPEDNEQ<br>KQLFVEQHKHYLDEIIEQISEFSKRVILADANLDKVLSAYNKHRDKPIREQAENIIHLFTLTNLGAPA<br>AFKYFDTTIDRKRYTSTKEVLDATFIHQSITGLYETRIDLSQLGGD |
| 74 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRGSKYPIFGNLAKEKTYHDEF<br>PTIYHLRKYLADSSKKADLRLVYLALAHMIKYRGHFLIEGDFNSRNNDIKKNFQNFLDSYNAIFESD<br>LSLENSEQLEEIVKDKISKSAKRERVLKLFPDEKSTGLFSEFLKIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIQNNLPEKYDEVFSDQSKDGYAGYIDGKTTQEAFYKYIKNLLSKLEGADYFLDKIEREDFL<br>RKQRTFDNGSIPHQIHLQEMNAIIRRQGEHYPPFLKENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEGL<br>RDYQFLDSGQKKQIVNQLFKEKRKVTEKDIIHYLHNVDGYDGIELKGIEKQFNASLSTYHDLLKIIK<br>DKEFMDDPKNEEILENIVHTLTIFEDREMIKQRLAQYDTLFDEKVIKALTRRHYTGWGKLSAKLIN<br>GISDKQTGKTILDFLIDDDKINRNFMQLINDDGLSFKEIIQKAQVIGETDNIKQVVQNLPGSPAIKKGI<br>LQSIKIVDELVKVMGHDPESIVIEMARENQTTNQGRRNSQQRYKRIEEAIKNLDSNLNSKILKEYPT<br>DNQALQNDRLFLYYLQNGKDMYTGQELDINQLSNYDIDHIVPQAFIKDDSLDNRVLTSSKDNRGK<br>SDNVPSIEIVQKRKAFWQQLLDSKLISERKENNLTKAERGGLNERDKVGFIKRQLVETRQITKHVA<br>QILDARFNTEVNAKGKKIRKVKIITLKSNLVSNFRKEFGLYKVREINDYHHAHDAYLNAVVAKAIL<br>KKYPKLEPEFVYGDYQKYDVKRYISRSKDPKDIEKATEKYFFYSNLLNFFKEEVHYADGTIVKREN<br>IEYSKDTGEIAWNKEKDFATVRKVLSCPQVNIVKKTEVQTGGFSKESILPKRNSDKLIARKKDWDP<br>KKYGGFDSPTVAYSVLVVAKVEGKSKKLKSVKELLGITIMERSSFEKNPIDFLEAKGYKEVRKDL<br>IVKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 75 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKKERLLKLFPGEKNSGILAEFLKIVGNQADFRKYFNLDEKASLHES<br>KESYDEDLETLLGHIGDDYSDVFLKAKKLYDAILLSGILTVTDNETEAPLSSAMIMRYKEHEEDLAL<br>LKAYIRNISLETYNEVFKDDTKNGYAGYIDGKTNQEDFYVYLKKLLTGLEGADYFLEKINREDLLR<br>KQRTFDNGSIPYQIHLQEMRAILDKQAKFYPPLAKNKERIEKILTFRIPYYVGPLARGNSDFAWSIRK<br>RNEKITPWNFEDVIDKESSAEAFINRMTSFDLYLPEEKVLPKHSLLYETFTVYNELTKVRFIAESMR<br>DYQFLDSKQKKDIVRLYFKGKRKVTDKDIIDYLHAIDGYDGIELKGIEKQFNSSLSTYHDLLKIIKD<br>KEFLDDSSNEAIIEEIIHTLTIFEDREMIKQRLSKFENIFKSLVKKLSRRHYTGWGKLSAKLINGIRD<br>EKSGKTILDYLIDDGISNRNFMQLIHDDTLSFKKKIQKAQIIGDQDNIKQVVQSLPGSPAIKKGILQSI<br>KIVDELVKVMGRRPESIVVEMARENQYTNQGKSNSQQRLKRLEESLKELGSKILKENVPAKLSKID<br>NNALQNERLYLYYLQNGKDMYTGQELDIDRLSNYDIDHIIPQAFLKDNSIDNKVLVSSASNRGKSD<br>DVPSLDVVKKRKTFWHQLLKSKLISQRKFDNLTKAERGGLTEDDKAGFIKRQLVETRQITKHVAQI<br>LDARFNTEVNEKNQKIRTVKIVTLKSNLVSNFRKEFELYKVREINDYHHAHDAYLNAVVAKAILTK<br>YPKLEPEFVYGDYPKYNSFRERKSATEKVYFYSNIMNTFKKSITLADGTVIDRPLIEVNEETGESVW<br>NKEKDFATVRKVLSCPQVNIVKKTEVQTGGFSKESILPKRNSDKLIARKKDWDPKKYGGFDSPTVA<br>YSVLVVAKVEGKSKKLKSVKELLGITIMERSSFEKNPIDFLEAKGYKEVRKDLIVKLPKYSLFELE<br>NGRKRMLASAGELQKGNELALPSKYVNFLYLASHYEKLKGSPEDNEQKQLFVEQHKHYLDEIIEQI<br>SEFSKRVILADANLDKVLSAYNKHRDKPIREQAENIIHLFTLTNLGAPAAFKYFDTTIDRKRYTSTK<br>EVLDATFIHQSITGLYETRIDLSQLGGD |

| SEQ ID NO | Nuclease Sequence |
|---|---|
| 76 | MNKPYSIGLDIGTNSVGWAVITDDYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLAKEKTYHDEF
PTIYHLRKYLADSTKKADLRLVYLALAHMIKYRGHFLIEGDFNSRNNDIKKNFQDFLDSYNAIFESD
LSLENSKQLEEIVKDKISKSAKRERVLKLFPDEKSTGLFSEFLKLIVGNQADFKKHFDLEEKAPLQFS
KDTYEDLENLLGQIGDDFADLFLVAKKLYDAILLSGILTVTDPSTKAPLSASMIDRYENHQKDLA
ALKQFIRKNLPEKYDEVFSDESKDGYAGYIDGKTTQENFYKYIKNAISKIEGADYFLEKIEREDFLR
KQRTFDNGSIPHQIHLQEMNAILHNQGEYYPFLKENKEKIEKILTFRIPYYVGPLARGNRDFAWLTR
NSDQAIRPWNFEEVVDQASSAEEFINKMTNYDLYLPEEKVLPKHSLLYETFAVYNELTKVKFIAEG
LRDYQFLDSGQKKQIVNQLFKEKRKVTEKDIIHYLHNVDGYDGIELKGIEKQFNASLSTYHDLLKII
KDKEFMDDPKNEEILENIVHTLTIFEDREMIKQRLAQYDTLFDEKVIKALTRRHYTGWGKLSAKLI
NGIRDKKSGKTILDYLIDDDKINRNFMQLIHDDGLSFKEIIQKAQVVGDSDNLKQVVQNLPGSPAIK
KGILQSIKIVDELVKVMGHDPEQIVIEMARENQTTNEGRRNSRQRYKLIEDGVKNLAKDLDGNILK
EYPTDNQALQNDRLFLYYLQNGKDMYTGEPLDINQLSSYDIDHIVPQAFIKDDSLDNRVLTSSKDN
RGKSDNVPSLEVVQKRKAFWQQLLDSKLISEHKFNNLTKAERGGLDERDKVGFIRRQLVETRQITK
HVAQILDARFNTEVNEKNQKIRTVKIVTLKSNLVSNFRKEFGLYKVREINDYHHAHDAYLNAVVA
KAILKKYPKLEPEFVYGDYQKYDLKRYISKSKDPKEVEKATQKYFFYSNLLNFFKEEVHYADGTII
KRENIEYSKDTGEIAWNKEKDFATVRKVLSCPQVNIVKKTEVQTGGFSKESILPKRNSDKLIARKK
DWDPKKYGGFDSPTVAYSVLVVAKVEKGKSKKLKSVKELLGITIMERSSFEKNPIDFLEAKGYKEV
RKDLIVKLPKYSLFELENGRKRMLASAGELQKGNELALPSKYVNFLYLASHYEKLKGSPEDNEQK
QLFVEQHKHYLDEIIEQISEFSKRVILADANLDKVLSAYNKHRDKPIREQAENIIHLFTLTNLGAPAA
FKYFDTTIDRKRYTSTKEVLDATFIHQSITGLYETRIDLSQLGGD |
| 77 | MTKPYSIGLDIGTNSVGWAVITDSYKVPSKKMKVLGNTSKKYVKKNLLGALLFESGITAEGRRLK
RTARRRYTRRRNRILYLQEIFSTEMNKIDESFFQRLDDSFLVPDDKRDSKYPIFGNLVKEKTYHDEF
PTIYHLRKYLADSSKKADLRLVYLALAHMIKYRGHFLIEGDFNSRNNDIKKNFQNFLDSYNAIFESD
LSLENSKQLEEIVKDKISKSAKRERVLKLFPDEKSTGLFSEFLKLIVGNQADFKKHFDLEEKAPLQFS
KDTYEDLENLLGQIGDGFADLFLVAKKLYDAILLSGILTVTDPSTKAPLSASMIERYENHQKDLAT
LKQFIKTNLPEKYDEVFSDQSKDGYAGYIDGKTTQEEFYKYLKNTLSKIEGSDYFLDKIEREDFLRK
QRTFDNGSIPHQIHLQEMNAIIRRQGEHYPFLKENKEKIEKILTFRIPYYVGPLARGNRDFAWLTRNS
DQAIRPWNFEEIVDQASSAEDFINKMTNYDLYLPEEKVLPKHSLLYETFAVYNELTKVKFIAEGLR
DYQFLDSGQKKQIVNQLFKDKRKVTEKDIIQYLHNVDGYDGIELKGIEKQFNASLSTYHDLLKIIKD
KEFMDDPKNEEILENIVHTLTIFEDREMIKQRLAKYANIFDKSVLKLARRHYTGWGKLSAKLINGI
YDKQSRKTILDYLIDDDKINRNFMQLINDDGLSFKEIIQKAQVVGKTDDVKQVVQELPGSPAIKKGI
LQSIKIVDELVKVMGHAPESIVIEMARENQTTARGKKNSQQRYKRIEDSLKNLASGLDSNILKENPT
DNIQLQNDRLFLYYLQNGKDMYTGESLDINQLSSYDIDHIIPQAFIKDDSLDNRVLTSSKDNRGKSD
NVPSIEVVQKRKAFWQQLLDSKLISERKENNLTKAERGGLDERDKVGFIRRQLVETRQITKHVAQI
LDARFNTEVNEKKQKIRKVKIITLKSNLVSNFRKEFRLYKVREINDYHHAHDAYLNAVVAKAILKK
YPKLEPEFVYGDYQKYDLKRYISKSKDPKEIEKATQKYFFYSNLLNFFKEEVHYADGTIIKRENIEY
SKDTGEIAWNKEKDFATVRKVLSCPQVNIVKKTEVQTGGFSKESILPKRNSDKLIARKKDWDPKK
YGGFDSPTVAYSVLVVAKVEKGKSKKLKSVKELLGITIMERSSFEKNPIDFLEAKGYKEVRKDLIV
KLPKYSLFELENGRKRMLASAGELQKGNELALPSKYVNFLYLASHYEKLKGSPEDNEQKQLFVEQ
HKHYLDEIIEQISEFSKRVILADANLDKVLSAYNKHRDKPIREQAENIIHLFTLTNLGAPAAFKYFDT
TIDRKRYTSTKEVLDATFIHQSITGLYETRIDLSQLGGD |
| 78 | MTKPYSIGLDIGTNSVGWAVITDNYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVKEKTYHDEF
PTIYHLRKYLADSQKKADLRLVYLALAHMIKYRGHFLIEGDFNSRNNDIKKNFQNFLDSYNAIFES
DLSLENSKQLEEIVKDKISKSAKRERVLKLFPDEKSTGLFSEFLKLIVGNQADFKKHFDLEEKAPLQF
SKDTYEDLENLLGQIGDDFADLFLVAKKLYDAILLSGILTVTDPSTKAPLSASMIERYENHQKDLA
ALKQFIQNNLPEKYDEVFSDQSKDGYAGYIDGKTTQEAFYKYIKNLLSKLEGSDYFLDKIEREDFL
RKQRTFDNGSIPHQIHLQEMNAIIRRQGEHYPFLKENKEKIEKILTFRIPYYVGPLARGNRDFAWLTR
NSDQAIRPWNFEEIVDKASSAEDFINKMTNYDLYLPEEKVLPKHSLLYETFAVYNELTKVKFIAEGL
RDYQFLDSGQKKQIVNQLFKEKRKVTEKDIIQFLHTVDGYDGIELKGIEKQFNASLSTYHDLLKIIK
DKEFMDDPKNEEILENIVHTLTIFEDREMIKQRLAQYDSLFDEKVIKALIRRHYTGWGKLSAKLING
IYDKQSKKTILDYLIDDDKINRNFMQLINDDGLSFKDIIQKAQVVGKTNDVKQVVQELPGSPAIKKG
ILQSIKLVDELVKVMGHAPESIVIEMARENQTTARGKKNSQQRYKRIEDALKNLAPGLDSNILKEHP
TDNIQLQNDRLFLYYLQNGRDMYTGEPLDINQLSSYDIDHIIPQAFIKDDSLDNRVLTSSKDNRGKS
DNVPSLEVVQKRKAFWQQLLDSKLISERKENNLTKAERGGLDERDKVGFIKRQLVETRQITKHVA
QILDARFNTEVDENNQRIRKVKIITLKSNLVSNFRKEFGLYKVREINDYHHAHDAYLNAVVAKAIL
KKYPKLEPEFVYGDYQKYDIKRYIRKFQPSKEIDKATEKYFFYSNLLNFFKEEVHYADGTIIKRENIE
YSKDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 79 | MKKPYSIGLDIGTNSVGWAVVTDDYKVPAKKMKVLGNTDKSHIKKNLLGALLFDSGETAEGRRL
KRTARRRYTRRRNRILYLQEIFAEEMNKVDESFFHRLDDSFLVPEDKRGSKYPIFATLEEEKEYHKK
FPTIYHLRKHLADSKEKTDLRLIYLALAHMIKYRGHFLYEESFDIKNNDIQKIFNEFISIYDNTFEGSS
LSGQNAQVEAIFTDKISKSAKRERVLKLFPDEKSTGLFSEFLKLIVGNQADFKKHFDLEEKAPLQFS
KDTYEDLENLLGQIGDDFADLFLVAKKLYDAILLSGILTVKDPSTKAPLSASMIKRYAEHHEDLE
KLKEFVKANAPELYHDIFKDESKNGYAGYIENGVKQDEFYKYLKNTLSKIEGSDYFLDKIEREDFL
RKQRTFDNGSIPHQIHLQEMNAIIRRQGEYYPFLQENKEKIEKILTFRIPYYVGPLARGNRDFAWLTR |

| SEQ ID NO | Nuclease Sequence |
|---|---|
| | NSDEAIRPWNFEEVVDKASSAEDFINKMTNYDLYLPEEKVLPKHSLLYEKFAVYNELTKVRYVTE<br>QGKSFFFDANMKQEIFDKTFKVYRKVTKEKLMDFLGKEFDEFRIVDLIGLDKDNKSFNASLGTYHD<br>LKKIVSKDFLDNPENEDILENVVLTLTLFEDREMIRKRLEKYKDVLTEEQQKKLERRHYTGWGRLS<br>AKLINGIRNKTTRKTILDYLIDDGTSNRNFMQLIHDDTLSFVDEIRLAQGSGEAEDYRAEVQNLAGS<br>PAIKKGILQSLKIVDELIEVMGYEPEHIVVEMARENQFTNQGRRNSQQRYKKIENAIKNLDSNLNSK<br>ILKEYPTNNQALQNDRLFLYYLQNGKDMYTGEALDINQLSNYDIDHIIPQAFIKDDSLDNRVLTSSK<br>DNRGKSDNVPSIEVVEKMKAFWQQLLDSKLISERKYNNLTKAERERGGLNELDKVGFIKRQLVET<br>RQITKHVAQILDARFNTEVDENNQRIRKVKIITLKSNLVSNFRKEFGLYKVREINDYHHAHDAYLN<br>AVVAKAILKKYPKLEPEFVYGDYQKYDIKRYISRSKDPKDIEKATEYFFYSNLLNFFKEEVHYAD<br>GTIIKRENIEYSKDTGEIAWNKEKDFATVRKVLSCPQVNIVKKTEVQTGGFSKESILPKRNSDKLIAR<br>KKDWDPKKYGGFDSPTVAYSVLVVAKVEKGKSKKLKSVKELLGITIMERSSFEKNPIDFLEAKGY<br>KEVRKDLIVKLPKYSLFELENGRKRMLASAGELQKGNELALPSKYVNFLYLASHYEKLKGSPEDN<br>EQKQLFVEQHKHYLDEIIEQISEFSKRVILADANLDKVLSAYNKHRDKPIREQAENIIHLFTLTNLGA<br>PAAFKYFDTTIDRKYTSTKEVLDATFIHQSITGLYETRIDLSQLGGD |
| 80 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFDSRNNDIKKNYQNFLDSYNAIFES<br>DLSLENNAQVEEIVKDKISKSAKRERVLKLFPDEKSTGLFSEFLKLIVGNQADFKKHFDLEEKAPLQ<br>FSKDTYDEDLENLLGQIGDDFADLFLVAKKLYDAILLSGILTVTDPSTKAPLSASMIERYENHQKDL<br>AALKQFIKNNLSEKYDEVFSDQSKDGYAGYINGKTTQEAFYKYIKNLLSKLEGADYFLDKIEREDF<br>LRKQRTFDNGSIPHQIHLQEMNAIIRRQGEHYPFLKENKEKIEKILTFRIPYYVGPLARGNRDFAWLT<br>RNSDQAIRPWNFEEVVDQASSAEDFINKMTNYDLYLPEEKVLPKHSLLYETFAVYNELTKVKFIAE<br>GLRDYQFLDSGQKKQIVNQLFKEKRKVTEKDIIQFLHNVDGYDGIELKGIEKQFNASLSTYHDLLKI<br>IKDKEFMDDPKNEEILENIVHTLTIFEDREMIKQRLAQYASIFDEKVIKALTRRHYTGWGRLSAKLIN<br>GIRDKQSRKTILDYLIDDDKINRNFMQLINDDGLSFKDIIQKAQVVGKTDDVKQVVQELPGSPAIKK<br>GILQSIKIVDELVKVMGKDPESIVIEMARENQTTNQGRRNSQQRYKRIEEAIKNLSIDLNSKILKEYP<br>TDNQALQNDRLFLYYLQNGKDMYTGEELDINQLSNYDIDHIVPQAFIKDDSLDNRVLTSSKDNRG<br>KSDNVPSIEVVQRRKAFWQQLLDSKLISERKENNLTKAERGGLNELDKVGFIKRQLVETRQITKHV<br>AQILDARFNTEVNENNQRIRKVKIITLKSNLVSNFRKEFGLYKVREINDYHHAHDAYLNAVVAKAI<br>LKKYPKLEPEFVYGDYQKYDIKRYISRSKDPKEIEKATEKYFFYSNLLNFFKEEVHYADGTIVKREN<br>IEYSKDTGEVAWNKEKDFATVRKVLSCPQVNIVKKTEVQTGGFSKESILPKRNSDKLIARKKDWDP<br>KKYGGFDSPTVAYSVLVVAKVEKGKSKKLSVKELLGITIMERSSFEKNPIDFLEAKGYKEVRKDL<br>IVKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKYTSTKEVLDATFIHQSITGLYETRIDLSQLGGD |
| 81 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKKADLRLVYLALAHMIKYRGHFLIEGDENSKNNDIKKNFQEFLDSYNAIFESDL<br>SLENSKQLEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLAAL<br>KQFIQNNLQEKYDEVFSDQSKDGYAGYIDGKTTQEAFYKYIKNLLSKLEGADYFLDKIEREDFLRK<br>QRTFDNGSIPHQIHLQEMNAILRRQGEHYPFLKENKEKIEKILTFRIPYYVGPLARGNRDFAWLTRN<br>SDQAIRPWNFEEIVDQASSAEDFINKMTNYDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLSTYHDLLKIIKD<br>KDFMDDPKNEEILENIVHTLTIFEDREMIKKRLEQYDSIFDEKVIKALTRRHYTGWGRLSAKLINGIR<br>DKQSNKTILDYLIDDDKINRNFMQLINDDGLSFKSIISKAQAGSHSDDLKEVVGELAGSPAIKKGILQ<br>SLKIVDELVKVMGYEPEQIVVEMARENQTTNQGRRNSRQRYKLLDDGIKNLAKDLDGNILKEYPT<br>NNQALQNDRLFLYYLQNGKDMYTGEALDINQLSSYDIDHVPQAFIKDDSIDNRVLTSSKDNRGKS<br>DNVPSLEVVQRRKAFWQQLLDSKLISERKENNLTKAERGGLDERDKVGFIRRQLVETRQITKHVA<br>QILDARFNTEVNENNQKIRKVKIITLKSNLVSNFRKEFGLYKVREINDYHHAHDAYLNAVVAKAIL<br>KKYPKLEPEFVYGDYQKYDIKRYISRSKDPKDIEKATEKYFFYSNLLNFFKEEVHYADGTIIKRENIE<br>YSKDTGEIAWNKEKDFATVRKVLSCPQVNIVKKTEVQTGGFSKESILPKRNSDKLIARKKDWDPKK<br>YGGFDSPTVAYSVLVVAKVEKGKSKKLSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKYTSTKEVLDATFIHQSITGLYETRIDLSQLGGD |
| 82 | MKKSYSIGLDIGTNSVGWSVVTDDYKVPAKKMKVFGNTDKKYIKKNLLGALLFDSGETAEGTRL<br>KRTARRRYTRRRNRILYLQEIFAKEMAKVDESFFQRLEESFLTDDDKNFDSHPIFGNKAEEDAYHE<br>QFPTIYHLRKHLADSSEKADLRLVYLALAHMIKFRGHFLIEGQLKAENTNVQTLFNDFVEVYDKTV<br>EESHLAEITVDALSILTEKVSKSRRLENLLKYYPTEKKNTLFQKLKLSLGLQPNFKTNFKLSEDAKL<br>QFSKDTYEEDLEELLGKIGDEYADLFTSAKNLYDAILLSGILTVDDKSTKAPLSASMLKRYVEHHE<br>DLEKLKDFVKANKPELYHDIFKDETKNGYAGYIENGVKQDEFYKYLKNTLSKIAGSDYFLDKIERE<br>DFLRKQRTFDNGSIPHQVHLQEMRAILRRQGEYYPFLKENQAKIEKILTFRIPYYVGPLARKDSRFA<br>WAEYHSDEKITPWNFDKVIDKESSARAFIEHMTNNDLYLPEEKVLPKHSPLYEKYTVYNELTKVK<br>YVTEQGKSSFFFDANMKQEIFEHVFKNRKVTKDKFLNYLNKEFPEYRIHDLIGLDKENKSFNASLG<br>TYHDLKKILDKSFLDNKENEEIIEDVVLTLTLFEDRDMIRQRLQKYSDIFTKDQLKKLERRHYTGW<br>GRLSYKLINGIRDKQSNKTILDYLLEDDGVKKNINRNFMQLINDDSLSFKTIIQEAQVIGIDDDIKAV<br>VHDLPGSPAIKKGILQSVKIVDELVKVMGHNPDNIVIEMARENQTTNRGRSQSQQRLKKLQESLKE<br>LGSNILNEEKPSYIEDKVENSHLQNDRLFLYYIQNGKDMYTGDELDIDHLSDYDIDHIIPQAFIKDNS<br>IDNRVLTSSAKNRGKSDDVPSLDIVRERKADWIRLYKAGLISRKFDNLTKAERGGLTENDKAGFI<br>KRQLVETRQITKHVAQILDARFNTKRDENDKVIRDVKIITLKSNLVSQFRKEFGFYKVREINDYHHA |

| SEQ ID NO | Nuclease Sequence |
|---|---|
| | HDAYLNAVVGTALIKKYPKLESEFVYGDYKVYDVRKMIAKSEQEIGKATAKRFFYSNIMNFFKTEI KLANGEIRKRPLIETNEETGEVVWNKERDFAIVRKVLSCPQVNIVKKTEVQTGGFSKESILPKRNSD KLIARKKDWDPKKYGGFDSPTVAYSVLVVAKVEKGKSKKLKSVKELLGITIMERSSFEKNPIDFLE AKGYKEVRKDLIVKLPKYSLFELENGRKRMLASAGELQKGNELALPSKYVNFLYLASHYEKLKGS PEDNEQKQLFVEQHKHYLDEIIEQISEFSKRVILADANLDKVLSAYNKHRDKPIREQAENIIHLFTLT NLGAPAAFKYFDTTIDRKRYTSTKEVLDATFIHQSITGLYETRIDLSQLGGD |
| 83 | MTKPYSIGLDIGTNSVGWAVITDDYKVPSKKMKVLGNTSKKYVKKNLLGALLFESGITAEGRRLK RTARRRYTRRRNRILYLQEIFATEMNKIDESFFQRLDDSFLVPDDKRDSKYPIFGNLAQEKTYHDEF PTIYHLRKYLADSSKKADLRLVYLALAHMIKYRGHFLIEGDFNSRNNDIKKNFQNFLDSYNAIFESD LSLENSEQLEEIVKDKISKSAKRERVLKLFPDEKSTGLFSEFLKIVGNQADFKKHFDLEEKAPLQFS KDTYDEDLENLLGQIGDDFADLFLVAKKLYDAILLSGILTVTDPSTKAPLSASMIERYENHQKDLA ALKQFIQNNLQEKYDEVFSDQSKDGYAGYIDGKTTQEAFYKYIKNLLSKFEGADYFLDKIEREDFL RKQRTFDNGSIPHQIHLQEMNAILRRQGEHYPPFLKENREKIEKILTFRIPYYVGPLARGNRDFAWLT RNSDQAIRPWNFEEIVDQASSAEEFINKMTNYDLYLPEEKVLPKHSLLYETFAVYNELTKVKFIAEG LRDYQFLDSGQKKQIVNQLFKEKRKVTEKDIIHYLHNVDGYDGIELKGIEKQFNASLSTYHDLLKII KDKEFMDDPKNEEILENIVHTLTIFEDREMIKQRLAQYDSLFDEKVIKALTRRHYTGWGKLSAKLIN GICDKQTGDTILDYLIDDDKINRNFMQLINDDGLSFKEIIQKAQVVGKTDDLKQVVQELPGSPAIKK GILQSIKIVDELVKVMGYEPEQIVIEMARENQTTNQGRRNSQQRYKLIEDGVKNLASDLNGNILKE YPTDNQALQNDRLFLYYLQNGKDMYTGEALDINQLSNYDIDHIVPQAFIKDDSLDNRVLTSSKDN RGKSDNVPSLEVVQKRKAFWQQLLLDSKLISERKFNNLTKAERGGLDERDKVGFIKRQLVETRQITK HVAQILDARFNTEVDESGKRIRKVKIITLKSNLVSNFRKEFGLYKVREINDYHHAHDAYLNAVVAK AILKKYPKLEPEFVYGDYQKYDLKRYISKSKNPKEVDKATQKYFFYSNLLNFFKEEVHYADGTIIK RENIEYSKDTGEIAWNKEKDFATVRKVLSCPQVNIVKKTEVQTGGFSKESILPKRNSDKLIARKKD WDPKKYGGFDSPTVAYSVLVVAKVEKGKSKKLKSVKELLGITIMERSSFEKNPIDFLEAKGYKEVR KDLIVKLPKYSLFELENGRKRMLASAGELQKGNELALPSKYVNFLYLASHYEKLKGSPEDNEQKQ LFVEQHKHYLDEIIEQISEFSKRVILADANLDKVLSAYNKHRDKPIREQAENIIHLFTLTNLGAPAAF KYFDTTIDRKRYTSTKEVLDATFIHQSITGLYETRIDLSQLGGD |
| 84 | MTKPYSIGLDIGTNSVGWAVITDSYKVPSKKMKVLGNTSKKYVKKNLLGALLFESGITAEGRRLK RTARRRYTRRRNRILYLQEIFSTEMAKIDESFFQRLDDSFLVPDDKRDSKYPIFGNLVKEKTYHDEF PTIYHLRKYLADSSKKADLRLVYLALAHMIKYRGHFLIEGDFNSRNNDIKKNFQNFLDSYNAIFESD LSLENSKQLEEIVKDKISKSAKRERVLKLFPDEKSTGLFSEFLKIVGNQADFKKHFDLEEKAPLQFS KDTYDEDLENLLGQIGDDFADLFLVAKKLYDAILLSGILTVTDPSTKAPLSASMIERYENHQKDLA ALKQFIKNNLPEKYDEVFSDQSKDGYAGYIDGKTTQEAFYKYIKNLLSKFEGADYFLEKIEREDFLR KQRTFDNGSIPHQIHLQEMNAILRHQGEYYPFLKENKEKIEKILTFRIPYYVGPLARGNRDFAWLTR NSDQAIRPWNFEEIVDKASSAEDFINKMTNYDLYLPEEKVLPKHSLLYETFAVYNELTKVKFIAEGL RDYQFLDSGQKKQIVNQLFKEKRKVTEKDIIHYLHNVDGYDGIELKGIEKQFNASLSTYHDLLKIIK DKEFMDDPKNEEILENIVHTLTIFEDREMIKQRLAQYDSVFDEKVIKALARRHYTGWGKLSAKLIN GIYDKQSKKTILDYLIDDDKINRNFMQLINDDGLSFKDIIQKAQVVGKTDDVKQVVQELPGSPAIKK GILQSIKIVDELVKVMGSDPESIVIEMARENQTTNQGRRNSQQRYKKIKEAIKNLDSELNSKILKEYP TNNQALQNDRLFLYYLQNGKDMYTGEPLDINQLSSYDIDHIVPQAFIKDDSLDNRVLTSSKDNRGK SDNVPSIEIVERMKGFWQQLLNSKLISERKFNNLTKAERGGLDERDKVGFIKRQLVETRQITKHVA QILDARFNTEVDSKGKKIRKVKIITLKSNLVSNFRKEFGLYKVREINDYHHAHDAYLNAVVAKAIL KKYPKLEPEFVYGDYQKYDLKRYISKSKNPKSIDKATQKYFFYSNLLNFFKEEVHYADGTIIKRENI EYSKDTGEIAWNKEKDFATVRKVLSCPQVNIVKKTEVQTGGFSKESILPKRNSDKLIARKKDWDPK KYGGFDSPTVAYSVLVVAKVEKGKSKKLKSVKELLGITIMERSSFEKNPIDFLEAKGYKEVRKDLI VKLPKYSLFELENGRKRMLASAGELQKGNELALPSKYVNFLYLASHYEKLKGSPEDNEQKQLFVE QHKHYLDEIIEQISEFSKRVILADANLDKVLSAYNKHRDKPIREQAENIIHLFTLTNLGAPAAFKYFD TTIDRKRYTSTKEVLDATFIHQSITGLYETRIDLSQLGGD |
| 85 | MTKPYSIGLDIGTNSVGWAVITDSYKVPSKKMKVLGNTSKKYVKKNLLGALLFESGITAEGRRLK RTARRRYTRRRNRILYLQEIFSTEMSKIDESFFQRLDDSFLVPDDKRDSKYPIFGNLVEEKVYHDEFP TIYHLRKYLADSSKKADLRLVYLALAHMIKYRGHFLIEGDFNSRNNDIKKNFQDFLDSYNAIFESDL SLENSKQLEEIVKDKISKSAKKDRLLKLFPGEKNSGIFSEFLKLIVGNQADFRKYFNLDEKASLHFSK ESYDEDLETLLGHIGDDYSDVFLKAKKLYDAILLSGILTVTDNETEAPLSSAMIMRYKEHEEDLALL KAYIRKISLETYNEVFKDDTKNGYAGYIDGKTNQEDFYVYLKKLLTGLEGADYFLEKINREDLLRK QRTFDNGSIPYQIHLQEMRAILDKQAKFYPPFLAKNKERIEKILTFRIPYYVGPLARGNSDFAWSIRKR NEKITPWNFEDVIDKESSAEAFINRMTSFDLYLPEEKVLPKHSLLYETFTVYNELTKVRFIAESMRD YQFLDSKQKKDIVRLYFKGKRKVTDKDIIDYLHAIDGYDGIELKGIEKQFNASLSTYHDLLKIIIKDK EFLDDSENEAIIEEIIHTLTIFEDREMIKQRLSKYEDVFSKSVLKLSRRHYTGWGKLSAKLINGIRDE KSGKTILDYLIDDGVSNRNFMQLIHDDTLSFKKKIQKAQIIGDQDNIKQVVQSLPGSPAIKKGILQSI KIVDELVKVMGRNPESIVVEMARENQYTNQGKSNSQQRLKRLEESLKELGSKILKENVPAKLSKID NNALQNERLYLYYLQNGKDMYTGEELDIDRLSDYDIDHIIPQAFIKDNSIDNKVLVSSASNRGKSD DVPSLDVVKKRKGFWHQLLKSKLISQRKFDNLTKAERGGLTDDDKAGFIKRQLVETRQITKHVAQ ILDARFNVKRDDDNKVIRDVKIVLLKSSLVSQFRKDFELYKVREINDFHHAHDAYLNAVVASALLK KYPKLEPEFVYGDYSKSHISKEQDKATAKYFFYSNLLNFFKSDQKYLTDGTVVFRENIEYSKDTGEI AWNKEKDFATVRKVLSCPQVNIVKKTEVQTGGFSKESILPKRNSDKLIARKKDWDPKKYGGFDSP TVAYSVLVVAKVEKGKSKKLKSVKELLGITIMERSSFEKNPIDFLEAKGYKEVRKDLIVKLPKYSLF ELENGRKRMLASAGELQKGNELALPSKYVNFLYLASHYEKLKGSPEDNEQKQLFVEQHKHYLDEI IEQISEFSKRVILADANLDKVLSAYNKHRDKPIREQAENIIHLFTLTNLGAPAAFKYFDTTIDRKRYT STKEVLDATFIHQSITGLYETRIDLSQLGGD |

| SEQ ID NO | Nuclease Sequence |
|---|---|
| 86 | MTKPYSIGLDIGTNSVGWAVITDSYKVPSKKMKVLGNTSKKYVKKNLLGALLFESGITAEGRRLK RTARRRYTRRRNRILYLQEIFAAEMNKIDESFFHRLDDSFLVPEDKRGSKYPIFGNLEEEKAYHEKF PTIYHLRKYLADSSKKADLRLVYLALAHMIKYRGHFLIEGDFNSRNNDIKKSFQNFLDSYNAIFESD LSLEQNAQVEEIVKDKISKSAKRERVLKLFPDEKSTGLFSEFLKLIVGNQADFKKHFDLEEKAPLQF SKDTYDEDLENLLGQIGDDFADLFLVAKKLYDAILLSGILTVTDPSTKAPLSASMIERYENHQKDLA ALKQFIQNNLQEKYDEVFSDQSKDGYAGYINGKTTQEAFYKYIKNLLSKLEGADYFLDKIEREDFL RKQRTFDNGSIPHQIHLQEMNAILRRQGEYYPFLKENREKIEKILTFRIPYYVGPLARGNRDFAWLT RNSDQAIRPWNFEEVVDQASSAEDFINKMTNYDLYLPEEKVLPKHSLLYETFAVYNELTKVKFIAE GLRDYQFLDSGQKKQIVNQLFKEKRKVTEKDIIHYLHNVDGYDGIELKGIEKQFNASLSTYHDLLKI IKDKEFMDDPKNEEILENIVHTLTIFEDREMIKQRLAQYDSLFDEKVIKALTRRHYTGWGKLSAKLI NGICDKQTGDTILDFLIDDDKINRNFMQLINDDGLSFKDIIQKAQVVGKTDDVKQVVQELPGSPAIK KGILQSIKIVDELVKVMGHAPESIVIEMARENQTTNQGKRNSQQRYKRIEEAIKNLAPELDGNILKE YPTDNQALQNDRLFLYYLQNGKDMYTGEELDINQLSNYDIDHIVPQAFIKDDSLDNRVLTSSKDNR GKSDNVPSLEVVQKRKAFWQQLLDSKLISERKYNNLTKAERERGGLNELDKVGFIKRQLVETRQIT KHVARILDERFNEEVDENKRIRKVKIITLKSNLVSNFRKEFELYKVREINDYHHAHDAYLNAVVAK AILKKYPKLEPEFVYGDYQKYDIKRYISRSKDSKEIDKATEKYFFYSNLLNFFKEEVHYADGTVVFR RNIEYSKDTGEIAWNKEKDFATVRKVLSCPQVNIVKKTEVQTGGFSKESILPKRNSDKLIARKKDW DPKKYGGFDSPTVAYSVLVVAKVEKGKSKKLKSVKELLGITIMERSSFEKNPIDFLEAKGYKEVRK DLIVKLPKYSLFELENGRKRMLASAGELQKGNELALPSKYVNFLYLASHYEKLKGSPEDNEQKQLF VEQHKHYLDEIIEQISEFSKRVILADANLDKVLSAYNKHRDKPIREQAENIIHLFTLTNLGAPAAFKY FDTTIDRKRYTSTKEVLDATFIHQSITGLYETRIDLSQLGGD |
| 87 | MKKPYSIGLDIGTNSVGWAVVTDDYKVPAKKMKVLGNTNKESIKKNLIGALLFDAGNTAADRRL KRTARRRYTRRRNRILYLQEIFAEEMNKVDESFFHRLDDSFLVPEDKRGSKYPIFATLEEEKEYHKK FPTIYHLRKHLADSKEKADLRLIYLALAHMIKYRGHFLYEESFDIKNNDIQKIFNEFISIYDNTFEGSS LSGQNAQVEAIFTDKISKSAKRERVLKLFPDEKSTGLFSEFLKLIVGNQADFKKHFDLEEKAPLQFS KDTYDEDLENLLGQIGDDFADLFLVAKKLYDAILLSGILTVTDPSTKAPLSASMIERYENHQKDLA ALKQFIQNNLQEKYDEVFSDQSKDGYAGYIDGKTTQEAFYKYIKNLLSKLEGADYFLDKIEREDFL RKQRTFDNGSIPHQIHLQEMNAIIRRQGEHPPFLKENKEKIEKILTFRIPYYVGPLARGNRDFAWLTR NSDQAIRPWNFEEIVDQASSAEDFINKMTNYDLYLPEEKVLPKHSLLYETFAVYNELTKVKFIAEG MRDYQFLDSGQKKKIVSQLFEDKRKVTEKDIIHYLHTIDGYDGIELSGIEKQFNASLSTYHDLLKIIK DKAFLDDSENEAIIEEIIHTLTIFEDREMIKQRLAQYADIFDKSVLKKLARRHYTGWGKLSAKLINGI RDKQSNKTILDYLIDDGKINRNFMQLINDDSLSFKETIQKAQVVGDTDDVKQVVQELPGSPAIKKGI LQSIKIVDELVKVMGHNPDNIVIEMARENQTTNRGRSQSQQRLKLQDSLKELGSNILNEEKPSYIE DKVENSHLQNDQLFLYYIQNGKDMYTGEELDIDHLSDYDIDHIIPQAFIKDDSIDNRVLTSSAKNRG KSDDVPSLDIVRERKADWIRLYKSKLISKRKFDNLTKAERGGLTEADKAGFIKRQLVETRQITKHV AQILDSRFNTKRDENDKVIRDVKVITLKSNLVSQFRKDFELYKVREINDYHHAHDAYLNAVVGTA LLKKYPKLAPEFVYGEYKKYDIRKFITSSKDKATAKYFFYSNLMNFFKRIIRYSNGKIVVRPVVEYS KDTGEIAWNKEKDFATVRKVLSCPQVNIVKKTEVQTGGFSKESILPKRNSDKLIARKKDWDPKKY GGFDSPTVAYSVLVVAKVEKGKSKKLKSVKELLGITIMERSSFEKNPIDFLEAKGYKEVRKDLIVKL PKYSLFELENGRKRMLASAGELQKGNELALPSKYVNFLYLASHYEKLKGSPEDNEQKQLFVEQHK HYLDEIIEQISEFSKRVILADANLDKVLSAYNKHRDKPIREQAENIIHLFTLTNLGAPAAFKYFDTTID RKRYTSTKEVLDATFIHQSITGLYETRIDLSQLGGD |
| 88 | MTKPYSIGLDIGTNSVGWAVITDSYKVPSKKMKVLGNTSKKYVKKNLLGALLFESGITAEGRRLK RTARRRYTRRRNRILYLQEIFSTEMAKVDESFFQRLDDSFLVPDDKRDSKYPIFGNLVEEKTYHDEF PTIYHLRKYLADSQKKADLRLVYLALAHMIKYRGHFLIEGDFNSRNNDIKKNFQNFLDSYNAIFES DLSLENSKQLEEIVKDKISKSAKRERVLKLFPDEKSTGLFSEFLKLIVGNQAEFKKHFDLEEKAPLQF SKDTYDEDLENLLGQIGDDFADLFLVAKKLYDAILLSGILTVTDPSTKAPLSASMIERYENHQKDLA ALKQFIKANLPEKYDEVFSDESKDGYAGYINGKTTQEAFYKYIKNLLSKFEGADYFLEKIEREDFLR KQRTFDNGSIPHQIHLQEMNAILRRQGEHPPFLKENKEKIQQILTFRIPYYVGPLARGNRDFAWLTR NSDQAIRPWNFEEIVDQASSAEDFINKMTNYDLYLPEEKVLPKHSLLYETFAVYNELTKVKFIAEGL RDYQFLDSGQKKQIVNQLFKEKRKVTEKDIIQFLHNVDGYDGIELKGIEKQFNASLSTYHDLLKIIK DKEFMDDPKNEEILENIVHTLTIFEDREMIKQRLAQYDSLFDEKVIKALTRRHYTGWGKLSAKLING IRDKQTSKTILDYLIDDGKINRNFMQLINDDGLSFKEIIQKAQVVGKTDDVKQVVQELPGSPAIKKGI LQSIKIVDELVKVMGHAPESIVIEMARENQTTARGKRNSQQRYKKIEEAVKNLASELDGNILKEYPT DNAQLQNERLFLYYLQNGRDMYTGKALDINNLSNYDIDHIVPQAFIKDDSIDNRVLTSSKDNRGKS DNVPSIEIVEKMKGFWQQLLNSKLISERKYNNLTKAERERGGLNELDKVGFIKRQLVETRQITKHV AQILDARFNTEVNEKNQKIRKVKIITLKSNLVSNFRKEFGLYKVREINDYHHAHDAYLNAVVAKAI LKKYPKLEPEFVYGDYQKYDIKRYISRSKDPKDIEKATEKYFFYSNLLNFFKEEVHYADGTIVKREN IEYSKDTGEIAWNKEKDFATVRKVLSCPQVNIVKKTEVQTGGFSKESILPKRNSDKLIARKKDWDP KKYGGFDSPTVAYSVLVVAKVEKGKSKKLKSVKELLGITIMERSSFEKNPIDFLEAKGYKEVRKDL IVKLPKYSLFELENGRKRMLASAGELQKGNELALPSKYVNFLYLASHYEKLKGSPEDNEQKQLFVE QHKHYLDEIIEQISEFSKRVILADANLDKVLSAYNKHRDKPIREQAENIIHLFTLTNLGAPAAFKYFD TTIDRKRYTSTKEVLDATFIHQSITGLYETRIDLSQLGGD |
| 89 | MTKPYSIGLDIGTNSVGWAVITDSYKVPSKKMKVLGNTSKKYVKKNLLGALLFESGITAEGRRLK RTARRRYTRRRNRILYLQEIFSTEMAKIDESFFQRLDDSFLVPDDKRDSKYPIFGNLVEEKTYHDEFP TIYHLRKYLADSTKKADLRLVYLALAHMIKYRGHFLIEGDFNSRNNDIKKNFQDFLDSYNAIFESD LSLENSKQLEEIVKDKISKSAKRERVLKLFPDEKSTGLFSEFLKLIVGNQADFKKHFDLEEKAPLQFS KDTYDEDLENLLGQIGDDFADLFLVAKKLYDAILLSGILTVTDPSTKAPLSASMIERYENHQKDLA ALKQFIQNNLQEKYDEVFSDQSKDGYAGYIDGKTTQEAFYKYIKNLLSKLEGADYFLDKIEREDFL RKQRTFDNGSIPHQIHLQEMNAILRRQGEHYPFLKENKEKIEKILTFRIPYYVGPLARGNRDFAWLT |

| SEQ ID NO | Nuclease Sequence |
|---|---|
| | RNSDQAIRPWNFEEIVDQASSAEDFINKMTNYDLYLPEEKVLPKHSLLYETFAVYNELTKVKFIAEG
LRDYQFLDSGQKKQIVNQLFKDKRKVTEKDIIHYLHTVDGYDGIELKGIEKQFNASLSTYHDLLKII
KDKEFMDDPKNEEILENIVHTLTIFEDREMIKQRLAQYDSLFDEKVIKALTRRHYTGWGKLSAKLIN
GIYDKQSKKTILDYLIDDDKINRNFMQLINDDGLSFKEIIQKAQVVGKTDDVKQVVQELPGSPAIKK
GILQSIKIVDELVKVMGHAPESIVIEMARENQTTNQGKRNSQQRYKRIEEAIKNLSIDLNSKILKEYP
TDNQALQNDRLFLYYLQNGKDMYTGKELDINQLSNYDIDHIVPQAFIKDDSLDNRVLTSSKDNRG
KSDNVPSIEVVQKRKAFWQQLLDSKLISQRKFDNLTKAERGGLTEDDKAGFIKRQLVETRQITKHV
AQILDARFNTEVDENGKRIRKVKIITLKSNLVSNFRKEFGLYKVREINDYHHAHDAYLNAVVAKAI
LKKYPKLEPEFVYGDYQKYDIKRYISRSKDPKDVEKATQKYFFYSNLLNFFKEEVHYADGTIIKRE
NIEYSKDTGEIAWNKEKDFATVRKVLSCPQVNIVKKTEVQTGGFSKESILPKRNSDKLIARKKDWD
PKKYGGFDSPTVAYSVLVVAKVEKGKSKKLKSVKELLGITIMERSSFEKNPIDFLEAKGYKEVRKD
LIVKLPKYSLFELENGRKRMLASAGELQKGNELALPSKYVNFLYLASHYEKLKGSPEDNEQKQLFV
EQHKHYLDEIIEQISEFSKRVILADANLDKVLSAYNKHRDKPIREQAENIIHLFTLTNLGAPAAFKYF
DTTIDRKRYTSTKEVLDATFIHQSITGLYETRIDLSQLGGD |
| 90 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKVYHDEF
PTIYHLRKYLADSSKKADLRLVYLALAHMIKYRGHFLIEGDFNSRNNDIKKNFQNFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLA
ALKQFVKANLPEKYDEVFSDQSKDGYAGYIDKTTQEAFYKYIKNLISKIEGADYFLEKIEREDFLR
KQRTFDNGSIPHQIHLQEMHAILHNQGEYYPFLKDNKEKIEKILTFRIPYYVGPLARGNRDFAWLTR
NSDQAIRPWNFEEIVDKASSAEDFINKMTNYDLYLPEEKVLPKHSLLYETFAVYNELTKVKFIAEGL
RDYQFLDSGQKKQIVNQLFKDKRKVTEKDIIQFLHNVDGYDGIELKGIEKQFNASLSTYHDLLKIIK
DKEFMDDPKNEEILENIIHTLTIFEDREMIKQRLAQYDSLFDEKVIKALTRRHYTGWGKLSAKLINGI
YDKQSRKTILDYLIDDDKINRNFMQLINDDGLSFKDIIQKAQVVGKTDDVKQVVQELPGSPAIKKGI
LQSIKIVDELVKVMGHAPESIVIEMARENQTTARGKKNSQQRYKRIEDALKNLAPGLDSNILKENPT
DNIQLQNDRLFLYYLQNGKDMYTGEALDINQLSNYDIDHIIPQAFIKDDSLDNRVLTSSKDNRGKS
DNVPSIEVVQKRKAFWQQLLDSKLISERKENNLTKAERGGLDERDKVGFIKRQLVETRQITKHVAQ
ILDARFNTEVDDNNKKIRKVKIITLKSNLVSNFRKEFGLYKVREINDYHHAHDAYLNAVVAKAILK
KYPKLEPEFVYGDYQKYDIKRYISRSKDPKDIEKATEKYFFYSNLLNFFKEEVHYADGTIIKRDKVE
YSNDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 91 | MTKPYSIGLDIGTNSVGWAVITDDYKVPSKKMKVLGNTSKKYVKKNLLGALLFESGITAEGRRLK
RTARRRYTRRRNRILYLQEIFSTEMNKIDEGFFQRLDDSFLVPDDKRDSKYPIFGNLVEEKTYHDEF
PTIYHLRKYLADSSKKADLRLVYLALAHMIKYRGHFLIEGDFNSRNNDIKKNFQDFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQNDLSA
LKQFIKRNLSEKYDEVFSDESKDGYAGYINGKTTQEAFYKYIKNLISKIEGADYFLEKIEREDFLRK
QRTFDNGSIPHQIHLQEMNAILRHQGEYYPFLQENKEKIEKILTFRIPYYVGPLARGNRDFAWLTRN
SDQAIRPWNFEEIVDQASSAEDFINKMTNYDLYLPEEKVLPKHSLLYETFAVYNELTKVKFIAEGLR
DYQFLDSGQKKQIVNQLFKEKRKVTEKDIIQFLHNVDGYDGIELKGIEKQFNASLSTYHDLLKIIKD
KEFMDDPKNEEILENIIHTLTIFEDREMIKQRLAQYDSLFDEKVIKALTRRHYTGWGKLSAKLINGIC
DKKTGKTILDYLIDDGEINRNFMQLIHDDGLSFKDIIQKAQVVGKTDDVKQVVQELPGSPAIKKGIL
QSIKIVDELVKVMGHAPESIVIEMARENQTTARGKKNSQQRYKRIEDALKNLAPGLDSNILKENPT
DNIQLQNDRLFLYYLQNGKDMYTGEPLDINQLSNYDIDHIVPQAFIKDDSLDNRVLTSSKDNRGKS
DNVPSIEVVQKRKAFWQQLLDSKLISERKENNLTKAERGGLDERDKVGFIKRQLVETRQITKHVAQ
ILDSRENTEVNDQGKKIRKVKIITLKSNLVSNFRKEFGLYKVREINDYHHAHDAYLNAVVAKAILK
KYPKLEPEFVYGDYQKYDIKRYISKSRNPKTIDKATQKYFFYSNLLNFFKEEVHYADGTIVKRENV
EYSNDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 92 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLAKEKTYHDEF
PTIYHLRKYLADSQKKADLRLVYLALAHMIKYRGHFLIEGDFNSRNNDIKKNFQKFLDSYNAIFES
DLSLENSKQLEEIVKDKISKSAKRERVLKLFPDEKSTGLFSEFLKLIVGNQAEFKKHFDLEEKAPLQF
SKDTYDEDLENLLGQIGDFADLFLVAKKLYDAILLSGILTVTDPSTKAPLSASMIERYENHQKDLA
ALKQFIQNNLQEKYDEVFSDQSKDGYAGYIDKTTQEAFYKYIKNTLSKIEGSDYFLDKIEREDFLR
KQRTFDNGSIPHQIHLQEMNAIIRRQGEHYPFLKENKEKIEKILTFRIPYYVGPLARGNRDFAWLTR
NSDQAIRPWNFEEVVDKASSAEDFINKMTNYDLYLPEEKVLPKHSLLYETFAVYNELTKVKFIAEG
LRDYQFLDSGQKKQIVNQLFKEKRKVTEKDIIHYLHTVDGYDGIELKGIEKQFNASLSTYHDLLKII
KDKEFMDDPKNEEILENIVHTLTIFEDREMIKQRLAQYDSLFDEKVIKALTRRHYTGWGKLSAKLIN
GIRDKKSGKTILDYLIDDGKINRNFMQLIHDDGLSFKEIIQKAQVVGKTDDVKQVVQELPGSPAIKK
GILQSIKIVDELVKVMGHAPESIVIEMARENQTTNRGKRNSQQRYKRIENAVKNLASELNGNILKEY
PTNNQALQNERLFLYYLQNGKDMYTGESLDINQLSSYDIDHIVPQAFIKDDSLDNRVLTSSKDNRG
KSDNVPSLEIVEKMKGFWQQLLDSKLISERKENNLTKAERGGLDERDKVGFIKRQLVETRQITKHV
AQILDARFNTEVNENNQKIRKVKIITLKSNLVSNFRKEFGLYKVREINDYHHAHDAYLNAVVAKAI |

| SEQ ID NO | Nuclease Sequence |
|---|---|
| | LKKYPKLEPEFVYGDYQKYDVKRYISRSKDPKEIEKATEKYFFYSNLLNFFKEEVHYADGTIIKREN
VEYSNDTGEIAWNKEKDFATVRKVLSCPQVNIVKKTEVQTGGFSKESILPKRNSDKLIARKKDWDP
KKYGGFDSPTVAYSVLVVAKVEKGKSKKLKSVKELLGITIMERSSFEKNPIDFLEAKGYKEVRKDL
IVKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 93 | MNKPYSIGLDIGTNSVGWAVITDSYKVPSKKMKVLGNTSKKYVKKNLLGALLFESGITAEGRRLK
RTARRRYTRRRNRILYLQEIFATEMAKIDESFFQRLDDSFLVPDDKRDSKYPIFGNLVEEKTYHDEF
PTIYHLRKYLADSQKKADLRLVYLALAHMIKYRGHFLIEGDFNSRNNDIKKNFQDFLDSYNAIFES
DLSLENNAQVEEIVKDKISKSAKRERVLKLFPDEKSTGLFSEFLKLIVGNQADFKKHFDLEEKAPLQ
FSKDTYDEDLENLLGQIGDDFADLFLVAKKLYDAILLSGILTVTDPSTKAPLSASMIERYENHQKDL
AALKQFVKANLPEKYDEVFSDQSKDGYAGYIDGKTTQEAFYKYIKNLLSKFEGADYFLEKIEREDF
LRKQRTFDNGSIPHQIHLQEMNAIIRRQGEHYPFLKENKEKIEKILTFRIPYYVGPLARGNRDFAWLT
RNSDQAIRPWNFEEIVDQASSAEDFINKMTNYDLYLPEEKVLPKHSLLYETFAVYNELTKVKFIAEG
LRDYQFLDSGQKKQIVNQLFKEKRKVTEKDIIHYLHTVDGYDGIELKGIEKQFNASLSTYHDLLKII
KDKEFMDDPKNEEILENIVHTLTIFEDREMIKQRLAQYDSLFDEKVIKALTRRHYTGWGKLSAKLIN
GISDKQTGNTILDFLIDDKKINRNFMQLIHDDGLSFKEIIQKAQVVGKTDDVKQVVQELPGSPAIKK
GILQSIKIVDELVKVMGHDPEHIVVEMARENQFTNQGRRNSQQRYKKIENAIKNLDSNLNSKILKE
YPTNNQALQNDRLFYYLQNGKDMYTGEALDINQLSNYDIDHIVPQAFIKDDSLDNRVLTSSKDN
RGKSDNVPSIEVVEKMKAFWQQLLDSKLISERKYNNLTKAERERGGLNELDKVGFIKRQLVETRQI
TKHVAQILDARFNTEVNEKGKKIRKVKIITLKSNLVSNFRKEFGLYKVREINDYHHAHDAYLNAVV
AKAILKKYPKLEPEFVYGDYQKYDIKRYISRSKDPKDVEKATEKYFFYSNLLNFFKEEVHYADGTI
VKRENIEYSKDTGEIAWNKEKDFATVRKVLSCPQVNIVKKTEVQTGGFSKESILPKRNSDKLIARK
KDWDPKKYGGFDSPTVAYSVLVVAKVEKGKSKKLKSVKELLGITIMERSSFEKNPIDFLEAKGYKE
VRKDLIVKLPKYSLFELENGRKRMLASAGELQKGNELALPSKYVNFLYLASHYEKLKGSPEDNEQ
KQLFVEQHKHYLDEIIEQISEFSKRVILADANLDKVLSAYNKHRDKPIREQAENIIHLFTLTNLGAPA
AFKYFDTTIDRKRYTSTKEVLDATFIHQSITGLYETRIDLSQLGGD |
| 94 | MTKPYSIGLDIGTNSVGWAVITDSYKVPSKKMKVLGNTSKKYVKKNLLGALLFESGITAEGRRLK
RTARRRYTRRRNRILYLQEIFATEMAKIDESFFQRLDDSFLVPDDKRDSKYPIFGNLVKEKTYHDEF
PTIYHLRKYLADSSKKADLRLVYLALAHMIKYRGHFLIEGDFNSRNNDIKKNFQNFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLAT
LKQFIKNNLSEKYDEVFSDQSKDGYAGYIDGKTTQEAFYKYIKNTLSKIEGSDYFLDKIEREDFLRK
QRTFDNGSIPHQIHLQEMNAILHRQGEHYPFLKENKEKIEQILTFRIPYYVGPLARGNRDFAWLTRN
SDQAIRPWNFEEVVDKASSAEDFINKMTNYDLYLPEEKVLPKHSLLYETFAVYNELTKVKFIAEGL
RDYQFLDSGQKKQIVNQLFKEKRKVTEKDIIHYLHNVDGYDGIELKGIEKQFNASLSTYHDLLKIIK
DKEFMDDPKNEEILENIVHTLTIFEDREMIKQRLAQYDSLFDEKVIKALTRRHYTGWGKLSAKLING
IYDKQSRKTILDYLIDDDKINRNFMQLIHDDGLSFKEIIQKAQVVQELPGSPAIKK
ILQSIKIVDELVKVMGHAPESIVIEMARENQTTARGKKNSQQRYKRIEEALKNLAPGLDSNILKEHP
TDNIQLQNDRLFLYYLQNGRDMYTGKPLDINQLSNYDIDHIVPQAFIKDDSIDNRVLTSSKDNRGKS
DNVPSLEVVQKRKAFWQQLLDSKLISERKENNLTKAERGGLDERDKVGFIKRQLVETRQITKHVA
QILDARFNTEVNDKKQIRKVKIITLKSNLVSNFRKEFGLYKVREINDYHHAHDAYLNAVVAKAIL
KKYPKLEPEFVYGDYQKYDLKRYISKSKDPKEIEKATQKYFFYSNLLNFFKEEVHYADGTIIKRENI
EYSKDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 95 | MTKPYSIGLDIGTNSVGWAVITDSYKVPSKKMKVLGNTSKKYVKKNLLGALLFESGITAEGRRLK
RTARRRYTRRRNRILYLQEIFSTEMSKIDEGFFQRLDDSFLVPDDKRDSKYPIFGNLVEEKVYHDEF
PTIYHLRKYLADSSKKADLRLVYLALAHMIKYRGHFLIEGDFNSRNNDIKKNFQDFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIQRYEDHQEDLK
KLKEFIRRNIPEKYDEVFADSSKNGYAGYIDGKTTQEEFYKYIKEKLNNIKGADYFLDKIEREDFLR
KQRTFDNGSIPHQIHLQEMNAIIRRQGEHYPFLKENKEKIEKILTFRIPYYVGPLARGNRDFAWLTR
NSDQAIRPWNFEEVVDQASSAEDFINKMTNYDLYLPEEKVLPKHSLLYETFAVYNELTKVKFIAEG
LRDYQFLDSGQKKQIVNQLFKEKRKVTEKDIIQFLHNVDGYDGIELKGIEKQFNASLSTYHDLLKII
KDKEFMDDPKNEEILENIVHTLTIFEDREMIKQRLAQYDSLFDEKVIKALTRRHYTGWGKLSAKLIN
GICDKKTGKTILDYLIDDGKINRNFMQLIHDDGLSFKEIIQKAQVVGKTDDVKQVVQELPGSPAIKK
GILQSIKIVDELVKVMGHAPESIVIEMARENQTTNQGKRNSQQRYKRIEDGVKNLASDLNGNILKE
YPTDNQALQNDRLFYYLQNGKDMYTGEELDINQLSNYDIDHIVPQAFIKDDSLDNRVLTSSKDNR
GKSDNVPSLEVVQKRKAFWQQLLDSKLISERKFNNLTKAERGGLDERDKVGFIKRQLVETRQITKH
VAQILDARFNTEKDENGKKIRKVKIITLKSNLVSNFRKEFGLYKVREINDYHHAHDAYLNAVVAK
AILKKYPKLEPEFVYGDYQKYDVKRYISRSKDPKEIEKATQKYFFYSNLLNFFKEEVHYADGTIIKR
ENIEYSNDTGEIAWNKEKDFATVRKVLSCPQVNIVKKTEVQTGGFSKESILPKRNSDKLIARKKDW
DPKKYGGFDSPTVAYSVLVVAKVEKGKSKKLKSVKELLGITIMERSSFEKNPIDFLEAKGYKEVRK
DLIVKLPKYSLFELENGRKRMLASAGELQKGNELALPSKYVNFLYLASHYEKLKGSPEDNEQKQLF
VEQHKHYLDEIIEQISEFSKRVILADANLDKVLSAYNKHRDKPIREQAENIIHLFTLTNLGAPAAFKY
FDTTIDRKRYTSTKEVLDATFIHQSITGLYETRIDLSQLGGD |

| SEQ ID NO | Nuclease Sequence |
|---|---|
| 96 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSQKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFNLEEKAPLHFS<br>KDTYDEDLENLLGQIGDDFADLFLVAKKLYDAILLSGILTVTDPSTKAPLSASMIDRYENHQKDLA<br>ALKQFIQNNLQEKYDEVFSDESKDGYAGYIDKTTQEAFYKYIKNLISKFEGADYFLEKIEREDFLR<br>KQRTFDNGSIPHQIHLQEMNAILHHQGEYYPFLKENSEKIQQILTFRIPYYVGPLARGNRDFAWLTR<br>NSDQAIRPWNFEEIVDKASSAEDFINKMTNYDLYLPEEKVLPKHSLLYETFAVYNELTKVKFIAEGL<br>RDYQFLDSGQKKQIVNQLFKEKRKVTEKDIIHYLHNVDGYDGIELKGIEKQFNASLSTYHDLLKIIK<br>DKEFMDDPKNEEILENIVHTLTIFEDREMIKQRLAQYDSLFDEKVIKALTRRHYTGWGKLSAKLING<br>ISDKQTGNTILDYLIDDDKINRNFMQLIHDDGLSFKEIIQKAQVVGKTDDVKQVVQELPGSPAIKKG<br>ILQSIKIVDELVKVMGHAPESIVIEMARENQTTNQGRRNSQQRYKLIEDGVKNLASDLNGNILKEYP<br>TNNQALQNDRLFLYYLQNGKDMYTGESLDINQLSSYDIDHIVPQAFIKDDSLDNRVLTSSKDNRGK<br>SDNVPSLEVVQKRKAFWQQLLDSKLISERKENNLTKAERGGLDERDKVGFIRRQLVETRQITKHVA<br>QILDARFNVEVNDKKQKIRNVKIITLKSNLVSNFRKEFGLYKVREINDYHHAHDAYLNAVVAKAIL<br>KKYPKLEPEFVYGDYQKYDIKRYISRSKDPKEIEKATEKYFFYSNLLNFFKEEVHYADGTIIKRENIE<br>YSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 97 | MTKPYSIGLDIGTNSVGWAVITDDYKVPSKKMKVLGNTSKKYVKKNLLGALLFESGITAEGRRLK<br>RTARRRYTRRRNRILYLQEIFSTEMNKIDESFFQRLDDSFLVPDDKRDSKYPIFGNLVEEKTYHDEFP<br>TIYHLRKYLADSQKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFPDLEEKAPLQFS<br>KDTYDEDLENLLGQIGDDYADLFLVAKKLYDAILLSGILTATNPITKAPLSASMIERYDKHHKDLV<br>LLKELVRRNLPEKYDEVFSDQSKDGYAGYIDGKTTQEAFYKYIKNTLNKIEGADYFLDKIEREDFL<br>RKQRTFDNGSIPHQIHLQEMNAILRRQGEHYPFLKENKEKIQQILTFRIPYYVGPLARGNRDFAWLT<br>RNSDQAIRPWNFEEIVDKASSAEDFINKMTNYDLYLPEEKVLPKHSLLYETFAVYNELTKVKFIAEG<br>LRDYQFLDSGQKKQIVNQLFKEKRKVTEKDIIQFLHNVDGYDGIELKGIEKQFNASLSTYHDLLKII<br>KDKEFMDDPKNEEILENIVHTLTIFEDREMIKQRLAQYDSLFDEKVIKALTRRHYTGWGKLSAKLIN<br>GIYDKQSKKTILDYLIDDDKINRNFMQLINDDGLSFKEIIQKAQVVGKTDDVKQVVQELPGSPAIKK<br>GILQSIKIVDELVKVMGHDPESIVIEMARENQTTNQGRRSQQRYKKIENAIKNLDSELNSKILKEYP<br>TDNQALQNERLFLYYLQNGKDMYTDEELDINQLSNYDIDHIVPQAFIKDDSLDNRVLTSSKDNRGK<br>SDNVPSIEVVQKRKAFWQQLLDSKLISERKENNLTKAERGGLDERDKVGFIKRQLVETRQITKHVA<br>QILDARFNTEVNEKKQKIRTVKIITLKSNLVSNFRKEFGLYKVREINDYHHAHDAYLNAVVAKAIL<br>KKYPKLEPEFVYGDYQKYDIKRYISKSKDPKDIEKATEKYFFYSNLLNFFKEEVHYADGTIIKRENIE<br>YSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 98 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQDFLDSYNAIFESDL<br>SLENSKQLEEIVKDKISKSAKKDRLLKLFPGEKNSGIFSEFLKLIVGNQADFRKYFNLDEKASLHESK<br>ESYDEDLETLLGHIGDDYSDVFLKAKKLYDAILLSGILTVTDNETEAPLSSAMIMRYKEHEGDLALL<br>KAYIRNISLETYNEVFKDDTKNGYAGYIDGKTNQEDFYVYLKKLLTGLEGADYFLEKINREDLLRK<br>QRTFDNGSIPYQIHLQEMRAIIDKQAKFYPPLAKNKERIEKILTFRIPYYVGPLARGNSDFAWSIRKR<br>NEKITPWNFEDVIDKESSAEAFINRMTSFDLYLPEEKVLPKHSLLYETFTVYNELTKVRFIAESMRD<br>YQFLDSKQKKDIVRLYFKGKRKVTDKDIIEYLHAIDGYDGIELKGIEKQFNSSLATYHDLLNIINDK<br>EFLDDSSNEAIIEEIIHTLTIFEDREMIKQRLSKFENIFDKSVLKKLSRRHYTGWGKLSAKLINGIRDE<br>KSGKTILDYLIDDGISNRNFMQLIHDDTLSPKKKIQKAQIIGDQDNIKQVVQSLPGSPAIKKGILQSIK<br>IVDELVKVMGRNPESIVVEMARENQYTNQGKSNSQQRLKRLEEAIKELGSNVLKKENPVLKETKID<br>NQALQNERLYLYYLQNGKDMYTGDDLDIDRLSNYDIDHIIPQAFLKDNIDNKVLVSSASNRGKSD<br>DVPSLDVVKKRKTFWHQLLKSKLISQRKFDNLTKAERGGLTPEDKAGFIRRQLVETRQITKHVARL<br>LDERFNVKRDDNDKLIRNVKIITLKSSLVSQFRKDFELYKVREINDPHHAHDAYLNAVVAKAILTK<br>YPKLEPEFVYGDYPKYNSFRERKSATQKVFFYSNIMNLFKKEVRLADGTIVVRPVIEYSKDTGEVA<br>WNKEKDFATVRKVLSCPQVNIVKKTEVQTGGFSKESILPKRNSDKLIARKKDWDPKKYGGFDSPT<br>VAYSVLVVAKVEKGKSKKLKSVKELLGITIMERSSFEKNPIDFLEAKGYKEVRKDLIVKLPKYSLFE<br>LENGRKRMLASAGELQKGNELALPSKYVNFLYLASHYEKLKGSPEDNEQKQLFVEQHKHYLDEII<br>EQISEFSKRVILADANLDKVLSAYNKHRDKPIREQAENIIHLFTLTNLGAPAAFKYFDTTIDRKRYTS<br>TKEVLDATFIHQSITGLYETRIDLSQLGGD |
| 99 | MTKPYSIGLDIGTNSVGWAVITDSYKVPSKKMKVLGNTSKKYVKKNLLGALLFESGITAEGRRLK<br>RTARRRYTRRRNRILYLQEIFAAEMNKIDESFFQRLDDSFLVPDDKRDSKYPIFGNLVEEKAYHDEF<br>PTIYHLRKYLADSSKKADLRLVYLALAHMIKYRGHFLIEGDFNSRNNDIKKNFQEFLDSYNAIFESD<br>LSLENSKQLEEIVKDKISKSAKRERVLKLFPDEKSTGLFSEFLKLIVGNQADFKKHFPDLEEKAPLQFS<br>KDTYDEDLENLLGQIGDDFADLFLVAKKLYDAILLSGILTVTDPSTKAPLSASMIERYENHQKDLAL<br>LKQFIKQNLSQEKYDEVFKDESKNGYAGYIENGVKQDEFYKLKNTLSKIEGSDYFLDKIEREDFL<br>RKQRTFDNGSIPHQIHLQEMNAIIRRQGEHYPFLKENKEKIEKILTFRIPYYVGPLARGNRDFAWLTR |

| SEQ ID NO | Nuclease Sequence |
|---|---|
| | NSDQAIRPWNFEEVVDQASSAEDFINKMTNYDLYLPEEKVLPKHSLLYETFAVYNELTKVKFIAEG LRDYQFLDSGQKKQIVNQLFKEKRKVTEKDIIQFLHNVDGYDGIELKGIEKQFNASLSTYHDLLKII KDKEFMDDPKNEEILENIVHTLTIFEDREMIKQRLAQYDSLFDEKVIKALTRRHYTGWGKLSAKLIN GICDKKTGKTILDYLIDDGEINRNFMQLINDDGLSFKEIIQKAQVVGKTDDVKQVVQELPGSPAIKK GILQSIKIVDELVKVMGHAPESIVIEMARENQTTARGKKNSQQRYKRIEDALKNLAPGLDSNILKEN PTDNIQLQNDRLFLYYLQNGKDMYTGEPLDINQLSSYDIDHIVPQAFIKDDSLDNRVLTSSKDNRG KSDNVPSIEVVQKRKAFWQQLLDSKLISERKENNLTKAERGGLDERDKVGFIKRQLVETRQITKHV AQILDARFNTEVNEKGQKIRKVKIITLKSNLVSNFRKEFGLYKVREINDYHHAHDAYLNAVVAKAI LKKYPKLEPEFVYGDYQKYDIKRYISRSKDPKDVEKATQKYFFYSNLLNFFKEEVHYADGTIIKRE NIEYSKDTGEVAWNKEKDFATVRKVLSCPQVNIVKKTEVQTGGFSKESILPKRNSDKLIARKKDW DPKKYGGFDSPTVAYSVLVVAKVEKGKSKKLKSVKELLGITIMERSSFEKNPIDFLEAKGYKEVRK DLIVKLPKYSLFELENGRKRMLASAGELQKGNELALPSKYVNFLYLASHYEKLKGSPEDNEQKQLF VEQHKHYLDEIIEQISEFSKRVILADANLDKVLSAYNKHRDKPIREQAENIIHLFTLTNLGAPAAFKY FDTTIDRKRYTSTKEVLDATFIHQSITGLYETRIDLSQLGGD |
| 100 | MKKPYSIGLDIGTNSVGWAVVTDDYKVPAKKMKVLGNTDKSHIKKNLLGALLFDSGETAEGRRL KRTARRRYTRRRNRILYLQEIFATEMAKVDESFFQRLDDSFLVPDDKRDSKYPIFGNLAQEKTYHD EFPTIYHLRKYLADSQKKADLRLVYLALAHMIKYRGHFLIEGDFNSRNNDIKKNFQDFLDSYNAIFE SDLSLENSKQLEEIVKDKISKSAKRERVLKLFPDEKSTGLFSEFLKLIVGNQADFKKHFDLEEKAPLQ FSKDTYDEDLENLLGQIGDDFADLFLVAKKLYDAILLSGILTVTDPSTKAPLSASMIERYENHQKDL AALKQFIQNNLQEKYDEVFSDQSKDGYAGYINGKTTQEAFYKYIKNLLSKLEGSDYFLDKIEREDF LRKQRTFDNGSIPHQIHLQEMNAIIRRQGEHYPFLQENKEKIEKILTFRIPYYVGPLARGNRDFAWLT RNSDQAIRPWNFEEVVDKASSAEDFINKMTNYDLYLPEEKVLPKHSLLYETFAVYNELTKVKFIAE GLRDYQFLDSGKKQIVNQLFKEKRKVTEKDIIHFLHNVDGYDGIELKGIEKQFNASLSTYHDLLKI IKDKEFMDDPKNEEILENIVHTLTIFEDREMIKQRLAQYDTLFDEKVIKALTRRHYTGWGKLSAKLI NGICDKQTGDTILDFLIDDDKINRNFMQLINDDGLSFKEIIQKAQVVGKTDDVKQVVQELPGSPAIK KGILQSIKIVDELVKVMGHNPESIVIEMARENQTTNQGRRNSQQRYKKIEEAIKNLDSNLNSKILKE YPTENQALQNDRLFLYYLQNGKDMYTDEELDINQLSNYDIDHIVPQAFIKDDSLDNRVLTSSKDNR GKSDNVPSIEIVQKRKGFWQQLLDSKLISERKENNLTKAERGGLDERDKVGFIKRQLVETRQITKH VAQILDARFNTEVNEKKQKIRTVKIITLKSNLVSNFRKEFGLYKVREINDYHHAHDAYLNAVVAKA ILKKYPKLEPEFVYGDYQKYDLKRYISRSKDPKDVEKATQKYFFYSNLLNFFKEEVHYADGTIIKRE NIEYSKDTGEIAWNKEKDFATVRKVLSCPQVNIVKKTEVQTGGFSKESILPKRNSDKLIARKKDWD PKKYGGFDSPTVAYSVLVVAKVEKGKSKKLKSVKELLGITIMERSSFEKNPIDFLEAKGYKEVRKD LIVKLPKYSLFELENGRKRMLASAGELQKGNELALPSKYVNFLYLASHYEKLKGSPEDNEQKQLFV EQHKHYLDEIIEQISEFSKRVILADANLDKVLSAYNKHRDKPIREQAENIIHLFTLTNLGAPAAFKYF DTTIDRKRYTSTKEVLDATFIHQSITGLYETRIDLSQLGGD |
| 101 | MTKPYSIGLDIGTNSVGWAVITDSYKVPSKKMKVLGNTSKKYVKKNLLGALLFESGITAEGRRLK RTARRRYTRRRNRILYLQEIFSTEMAKIDESFFQRLDDSFLVPDDKRDSKYPIFGNLVKEKTYHDEF PTIYHLRKYLADSSKKADLRLVYLALAHMIKYRGHFLIEGDFNSRNNDIKKNFQNFLDSYNAIFESD LSLENSKQLEEIVKDKISKSAKRERVLKLFPDEKSTGLFSEFLKLIVGNQADFKKHFDLEEKAPLQFS KDTYDEDLENLLGQIGDDFADLFLVAKKLYDAILLSGILTVTDPSTKAPLSASMIERYENHQKDLA ALKQFIKNNLSEKYDEVFSDQSKDGYAGYIDKTTQEAFYKYIKNLLSKFEGADYFLEKIEREDFLR KQRTFDNGSIPHQIHLQEMNAILRRQGEHYPFLKENKEKIEKILTFRIPYYVGPLARGNRDFAWLTR NSDQAIRPWNFEEVVDKASSAEDFINKMTNYDLYLPEEKVLPKHSLLYETFAVYNELTKVKFIAEG LRDYQFLDSGQKKQIVNQLFKEKRKVTEKDIIHYLHNVDGYDGIELKGIEKQFNASLSTYHDLLKII KDKEFMDDPKNEEILENIVHTLTIFEDREMIKQRLAQYDSLFDEKVIKALTRRHYTGWGKLSAKLIN GIYDKQSKKTILDYLIDDDKINRNFMQLIHDDGLSFKEIIQKAQVVGKTDDVKQVVQELPGSPAIKK GILQSIKIVDELVKVMGHAPESIVIEMARENQTTNQGRRNSQQRYKLIEDGVKNLASDLNGNILKEY PTNNQALQNERLFLYYLQNGKDMYTGEALDINQLSSYDIDHIIPQAFIKDDSLDNRVLTSSKDNRG KSDNVPSIEVVQKRKAFWQQLLDSKLISERKENNLTKAERGGLDERDKVGFIKRQLVETRQITKHV AQILDARFNTEVDETGKKIRKVKIITLKSNLVSNFRKEFGLYKVREINDYHHAHDAYLNAVVAKAI LKKYPKLEPEFVYGDYQKYDIKRYISKSKDPKDIEKATEKYFFYSNLLNFFKEKVTYADGTITKREN IEYSKDTGEIAWNKEKDFATVRKVLSCPQVNIVKKTEVQTGGFSKESILPKRNSDKLIARKKDWDP KKYGGFDSPTVAYSVLVVAKVEKGKSKKLKSVKELLGITIMERSSFEKNPIDFLEAKGYKEVRKDL IVKLPKYSLFELENGRKRMLASAGELQKGNELALPSKYVNFLYLASHYEKLKGSPEDNEQKQLFVE QHKHYLDEIIEQISEFSKRVILADANLDKVLSAYNKHRDKPIREQAENIIHLFTLTNLGAPAAFKYFD TTIDRKRYTSTKEVLDATFIHQSITGLYETRIDLSQLGGD |
| 102 | MNKPYSIGLDIGTNSVGWAVITDNYKVPSKKMKVLGNTSKKYVKKNLLGALLFESGITAEGRRLK RTARRRYTRRRNRILYLQEIFIDGMNEIDESFFQRLDDSFLVPDDKRDSKYPIFGNLVEEKTYHDEFP TIYHLRKYLADSSKKADLRLVYLALAHMIKYRGHFLIEGDFNSRNNDIKKNFQEFLDSYNAIFESDL SLENSKQLEEIVKDKISKSAKRERVLKLFPDEKSTGLFSEFLKLIVGNQAEFKKHFDLEEKAPLQFSK DTYDEDLENLLGQIGDDFADLFLVAKKLYDAILLSGILTVTDPSTKAPLSASMIERYENHQKDLAAL KQFIQNNLQEKYDEVFSDQSKDGYAGYIDKTTQEAFYKYIKNLLSKLEGADYFLDKIEREDFLRK QRTFDNGSIPHQIHLQEMNAILRRQGEHYPFLKENKEKIEKILTFRIPYYVGPLARGNRDFAWLTRN SDQAIRPWNFEEIVDKASSAEDFINKMTNYDLYLPEEKVLPKHSLLYETFAVYNELTKVKFIAEGLR DYQFLDSGQKKQIVNQLFKEKRKVTEKDIIQYLHNVDGYDGIELKGIEKQFNASLSTYHDLLKIIKD KEFMDDPKNEEILENIVHTLTIFEDREMIKQRLAQYDSLFDEKVIKALTRRHYTGWGKLSAKLIDGI YDKQSRKTILDYLIDDDKINRNFMQLINDDGLSFKEIIQKAQVVGKTDDVKQVVQELPGSPAIKKGI LQSIKIVDELVKVMGHDPESIVIEMARENQTTNQGRRNSQQRYKIENAIKNLDSNLNSKILKEYPT NNQALQNDRLFLYYLQNGKDMYKDQELDINQLSNYDIDHIVPQAFIKDDSLDNRVLTSSKDNRGK SDNVPSLEVVQKRKGFWQQLLDSKLISERKENNLTKAERGGLDERDKVGFIKRQLVETRQITKHVA QILDARFNTEVNENNQRIRKVKIITLKSNLVSNFRKEFGLYKVREINDYHHAHDAYLNAVVAKAIL |

| SEQ ID NO | Nuclease Sequence |
|---|---|
| | KKYPKLEPEFVYGDYQKYDVKRYISRSKDPKDIEKATEKYFFYSNLLNFFKEEVHYADGTIVKREN
VEYSNDTGEIAWNKEKDFATVRKVLSCPQVNIVKKTEVQTGGFSKESILPKRNSDKLIARKKDWDP
KKYGGFDSPTVAYSVLVVAKVEKGKSKKLKSVKELLGITIMERSSFEKNPIDFLEAKGYKEVRKDL
IVKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 103 | MNKPYSIGLDIGTNSVGWAVITDSYKVPSKKMKVLGNTSKKYVKKNLLGALLFESGITAEGRRLK
RTARRRYTRRRNRILYLQEIFSTEMNKIDESFFQRLDDSFLVPDDKRDSKYPIFGNLAQEKTYHEEFP
TIYHLRKYLADSQKKADLRLVYLALAHMIKYRGHFLIEGDFNSRNNDIKKNFEKFLDSYNAIFESD
LSLENSAQVEEIVKDKISKSAKRERVLKLFPDEKSTGLFSEFLKLIVGNQADFKKHFDLEEKAPLQFS
KDTYDEDLENLLGQIGDGFADLFLVAKKLYDAILLSGILTVTDPSTKAPLSASMIERYENHQKDLA
ALKQFIKSNLSEKYDEVFSDQSKDGYAGYINGKTTQEAFYKYIKNLLSKFEGADYFLEKIEREDFLR
KQRTFDNGSIPHQIHLQEMHAILHRQGEYYPFLKENKEKIEKILTFRIPYYVGPLARGNRDFAWLTR
NSDQAIRPWNFEEIVDQASSAEDFINKMTNYDLYLPEEKVLPKHSLLYETFAVYNELTKVKFIAEGL
RDYQFLDSGQKKQIVNQLFKEKRKVTEKDIIHYLHNVDGYDGIELKGIEKQFNASLSTYHDLLKIIK
DKEFMDDPKNEEILENIVHTLTIFEDREMIKQRLAQYDSLFDEKVIKALTRRHYTGWGKLSAKLING
ICDKQTGDTILDFLIDDDKINRNFMQLINDDGLSFKEIIQKAQVVGKTDDVKQVVQELPGSPAIKKGI
LQSIKIVDELVKVMGHAPESIVIEMARENQTTNQGRRNSQQRYKKIENAIKNLDSNLNSKILKEYPT
DNQALQNDRLFLYYLQNGKDMYTDEELDINQLSNYDIDHIVPQAFIKDDSLDNRVLTSSKDNRGK
SDNVPSLEVVQKRKAFWQQLLDSKLISERKYNNLTKAERERGGLNELDKVGFIKRQLVETRQITKH
VAQILDARFNTEVNEKKQKIRTVKIITLKSNLVSNFRKEFGLYKVREINDYHHAHDAYLNAVVAKA
ILKKYPKLEPEFVYGDYQKYDIKRYISKSKDPKEIDKATEKYFFYSNLLNFFKEEVHYADGTIIKREN
IEYSKDTGEIAWNKEKDFATVRKVLSCPQVNIVKKTEVQTGGFSKESILPKRNSDKLIARKKDWDP
KKYGGFDSPTVAYSVLVVAKVEKGKSKKLKSVKELLGITIMERSSFEKNPIDFLEAKGYKEVRKDL
IVKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 104 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKTYHDEFP
TIYHLRKYLADSSKKADLRLVYLALAHMIKYRGHFLIEGDFNSRNNDIKKNFQEFLDSYNAIFESDL
SLENSKQLEEIVKDKISKSAKRERVLKLFPDEKSTGLFSEFLKLIVGNQADFKKHFDLEEKAPLQFSK
DTYDEDLENLLGQIGDGFADLFLVAKKLYDAILLSGILTVTDPSTKAPLSASMIERYENHQKDLAAL
KQFIKSNLSEKYDEVFSDQSKDGYAGYIDGKTTQEAFYKYIKNLLSKFEGADYFLDKIEREDFLRK
QRTFDNGSIPHQIHLQEMNAIIRRQGEHYPFLKENKEKIEKILTFRIPYYVGPLARGNRDFAWLTRNS
DQAIRPWNFEEIVDQASSAEDFINKMTNYDLYLPEEKVLPKHSLLYETFAVYNELTKVKFIAEGLR
DYQFLDSGQKKQIVNQLFKEKRKVTEKDIIHYLHNVDGYDGIELKGIEKQFNASLSTYHDLLKIIKD
KAFMDDAKNEEILENIVHTLTIFEDREMIKQRLAQYDSLFDEKVIKALTRRHYTGWGKLSAKLINGI
CDKQTGNTILDYLIDDDKINRNFMQLINDDGLSFKEIIQKAQVVGKTDDLKQVVQNLPGSPAIKKGI
LQSIKLVDELVKVMGSDPESIVIEMARENQTTNQGRRNSQQRYKLLEDGVKNLASDLNGNILKEYP
TDNQALQNERLFLYYLQNGKDMYTGEALDINQLSSCDIDHIIPQAFIKDDSLDNRVLTSSKDNRGK
SDNVPSIEIVQKMKGFWQQLLDSKLISERKENNLTKAERGGLDERDKVGFIRRQLVETRQITKHVA
QILDARFNTEVNEKKQKIRKVKIITLKSNLVSNFRKEFGLYKVREINDYHHAHDAYLNAVVAKAIL
KKYPKLEPEFVYGDYQKYDIKRYISRSKDPKTIEKATQKYFFYSNLLNFFKEEVHYADGTIVKRENI
EYSKDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 105 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKTYHDEFP
TIYHLRKYLADSTKKADLRLVYLALAHMIKYRGHFLIEGEFNSKNNDIKKNFQNFLDSYNAIFESDL
SLENSAQVEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLA
ALKQFIQNNLQEKYDEVFSDQSKDGYAGYIDGKTTQEAFYKYIKNLLSKLEGADYFLDKIEREDFL
RKQRTFDNGSIPHQIHLQEMNAIIRRQGEHYPFLQENKEKIEKILTFRIPYYVGPLARGNRDFAWLTR
NSDQAIRPWNFEEIVDKASSAEDFINKMTNYDLYLPEEKVLPKHSLLYETFAVYNELTKVKFIAEGL
RDYQFLDSGQKKQIVNQLFKEKRKVTEKDIIHFLHNVDGYDGIELKGIEKQFNASLSTYHDLLKIIK
DKEFMDDPKNQEILENIVHTLTIFEDREMIKQRLAQYDSLFDEKVIKALTRRHYTGWGKLSAKLIN
GICDKQTGKTILDYLIDDGEINRNFMQLIHDDGLSFKEIIQKAQVVGKTDDVKQVVQELPGSPAIKK
GILQSIKIVDELVKVMGHAPESIVIEMARENQTTARGKKNSQQRYKRIEDAIKNLAPELDSKILKEYP
TDNQALQNDRLFLYYLQNGKDMYTGNPLDINRLSDYDIDHIIPQAFIKDDSIDNRVLTSSKDNRGKS
DNVPSLEVVEKMKGFWQQLLKSKLISQRKFDNLTKAERGGLTEHDKAGFIKRQLVETRQITKHVA
QILDARFNTEVNDKKQKIRNVKIITLKSNLVSNFRKEFGLYKVREINDYHHAHDAYLNAVVAKAIL
KKYPKLEPEFVYGDYQKYDIKRYISRSKDPKDIEKATEKYFFYSNLLNFFKEEVHYADGTIVKRENI
EYSKDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |

-continued

| SEQ ID NO | Nuclease Sequence |
|---|---|
| 106 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKTYHDEFP
TIYHLRKYLADSSKKADLRLVYLALAHMIKYRGHFLIEGDENSKNNDIKKNYQNFLDSYNAIFESD
LSLENNAQVEEIVKDKISKSAKRERVLKLFPDEKSTGLFSEFLKLIVGNQADFKKHFDLEEKAPLQF
SKDTYDEDLENLLGQIGDDFADLFLVAKKLYDAILLSGILTVTDPSTKAPLSASMIERYENHQKDLA
ALKQFVRSNLPEKYDEVFSDQSKDGYAGYIDGKTTQEAFYKYIKNLLSKFEGSDYFLDKIEREDFL
RKQRTFDNGSIPHQIHLQEMKAIIHRQGEHYPFLQENKEKIEKILTFRIPYYVGPLARGNRDFAWLT
RNSDQAIRPWNFEEIVDKASSAEDFINKMTNYDLYLPEEKVLPKHSLLYETFAVYNELTKVKFIAEG
LRDYQFLDSGQKKQIVNQLFKEKRKVTEKDIIQFLHNVDGYDGIELKGIEKQFNASLSTYHDLLKII
KDKEFMDDPKNEEILENIVHTLTIFEDREMIKQRLAQYDSLFDEKVIKALTRRHYTGWGKLSAKLIN
GIYDKQSKKTILDYLIDDDKINRNFMQLINDDGLSFKEIIQKAQVVGETDDLKQVVQNLPGSPAIKK
GILQSIKIVDELVKVMGSDPESIVIEMARENQTTNQGRRNSQQRYKKIEDAIKNLDSNLNSKILKEYP
TDNQALQNDRLFLYYLQNGKDMYTGEELDINQLSNYDIDHIIPQAFIKDDSLDNRVLTSSKDNRGK
SDNVPSIEVVEKMKGFWQQLLNSKLISEHKFNNLTKAERGGLDERDKVGFIKRQLVETRQITKHVA
QILDARFNTEVNENGKKIRKVKIITLKSNLVSNFRKEFGLYKVREINDYHHAHDAYLNAVVAKAIL
KKYPKLEPEFVYGDYQKYDIKRYISRSKDPKDVEKATQKYFFYSNLLNFFKEEVHYADGTIIKRENI
EYSKDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 107 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKAYHDEF
PTIYHLRKYLADSSKKADLRLVYLALAHMIKYRGHFLIEGDFNSRNNDIKKNFQEFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDGFADLFLVAKKLYDAILLSGILTVTDPSTKAPLSASMIERYENHQKDLA
ALKQFIKANLPEKYDEVFSDQSKDGYAGYIDGKTTQEAFYKYIKNLLSKFEGADYFLDKIEREDFL
RKQRTFDNGSIPHQIHLQEMNAILRRQGEHYPFLKENKEKIEKILTFRIPYYVGPLARGNRDFAWLT
RNSDQAIRPWNFEEIVDQASSAEDFINKMTNYDLYLPEEKVLPKHSLLYETFAVYNELTKVKFIAEG
LRDYQFLDSGQKKQIVNQLFKEKRKVTEKDIIQFLHNVDGYDGIELKGIEKQFNASLSTYHDLLKII
KDKEFMDDPKNEEILENIVHTLTIFEDREMIKQRLAQYDSLFDEKVIKALTRRHYTGWGKLSAKLIN
GIRDKKSGKTILDYLIDDDKINRNFMQLINDDGLSFKEIIQKAQVVGKTDDLKQVVQELPGSPAIKK
GILQSIKIVDELVKVMGHNPENIVVEMARENQFTNQGRRNSQQRYKKIKEAIKNLDSNLNSKILKE
YPTDNQALQNDRLFLYYLQNGKDMYTGEALDINQLSNYDIDHIIPQAFIKDDSLDNRVLTSSKDNR
GKSDNVPSIEVVEKMKAFWQQLLDSKLISERKENNLTKAERERGGLNELDKVGFIKRQLVETRQIT
KHVAQILDARFNTEVNEKNQKIREVKIITLKSNLVSNFRKEFGLYKVREINDYHHAHDAYLNAVVA
KAILKKYPKLEPEFVYGDYQKYDIKRYISRSKDPKEIEKATEKYFFYSNLLNFFKEEVHYADGTIVK
RENIEYSKDTGEIAWNKEKDFATVRKVLSCPQVNIVKKTEVQTGGFSKESILPKRNSDKLIARKKD
WDPKKYGGFDSPTVAYSVLVVAKVEKGKSKKLKSVKELLGITIMERSSFEKNPIDFLEAKGYKEVR
KDLIVKLPKYSLFELENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQAENIIHLFTLTNLGAPAAF
KYFDTTIDRKRYTSTKEVLDATFIHQSITGLYETRIDLSQLGGD |
| 108 | MKKPYSIGLDIGTNSVGWAVVDDDYKVPAKKMRVFGDTDKGHIKKNLLGTLLFDSGETAESRRL
KRTARRRYTRRRNRILYLQEIFAEEMSKVDDSFFHRLEESFLTDDDKNFDSHPIFGNKAEEDAYHQ
KFPTIYHLRKHLADSTEKADLRLVYLALAHMIKFRGHFLIEGQLNAENTDVQTLFNDFVEVYDKTV
EESHLAEITVDALSILTEKVSKSRRLENLIKHYPTEKKNTLFGNLVALALGLQPNFKTNFKLSEDAK
LQFSKDTYEEDLEELLGKIGDDYADLFTSAKNLYDAILLSGILTVTDNSTKAPLSASMIKRYAEHHE
DLEKLKEFIKANKPELYHDIFKDETKNGYAGYIENGVKQDEFYKYLKNTLSKIAGSDYFLDKIERE
DFLRKQRTFDNGSIPHQIHLQEMHAILRRQGDYYPFLKENQAKIEKILTFRIPYYVGPLARKNSRFA
WAEYHSDEPITPWNFDEVVDKEKSAEKFITRMTMNDLYLPEEKVLPKHSVYETYTVYNELTKIK
YVNEQGESFFFDANMKQEIFDHVFKENRKVSKEKILNYLNKEFPEYRIQDLIGLDKENKSFNASLGT
YHDLKKILDKSFLDDKTNEQIIEDIVLTLTLFEDRDMIRERLQKYSDIFTKQQLKKLERRHYTGWGR
LSYKLINGIRNKENNKTILDFLIDDGRANRNFMQLINDDSLSFKTIIQEAQVVGDVDDIEAVVHDLP
GSPAIKKGILQSVKIVDELVKVMGHNPDNIVIEMARENQTTNRGRSQSQQRLKKLQESLKELGSNIL
NEEKPSYIEDKVENSHLQNDRLFLYYIQNGKDMYTGDELDIDHLSDYIDHIIPQAFIKDDSIDNRVL
TSSAKNRGKSDDVPSLDIVHDRKADWIRLYKSGLISKRKFDNLTKAERGGLTEADKAGFIKRQLVE
TRQITKHVAQILDGRFNTKRDENDKVIRDVKVITLKSNLVSQFRKDPGFYKVREINDYHHAHDAYL
NAVVGTALLKKYPKLAPEFVYGEYKKYDIRKFITNSSDKATAKYFFYSNLMNFFKRVIRYSNGTVI
VRPVIEYSKDTGEIAWNKEKDFATVRKVLSCPQVNIVKKTEVQTGGFSKESILPKRNSDKLIARKKD
WDPKKYGGFDSPTVAYSVLVVAKVEKGKSKKLKSVKELLGITIMERSSFEKNPIDFLEAKGYKEVR
KDLIVKLPKYSLFELENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQAENIIHLFTLTNLGAPAAF
KYFDTTIDRKRYTSTKEVLDATFIHQSITGLYETRIDLSQLGGD |
| 109 | MTKPYSIGLDIGTNSVGWAVITDSYKVPSKKMKVLGNTSKKYVKKNLLGALLFESGITAEGRRLK
RTARRRYTRRRNRILYLQEIFSTEMSKIDESFFQRLDDSFLVPDDKRDSKYPIFGNLVEEKTYHDEFP
TIYHLRKYLADSSKKADLRLVYLALAHMIKYRGHFLIEGDFNSRNNDIKKNFQDFLDSYNAIFESDL
SLENSKQLEEIVKDKISKSAKKDRILKLFPGEKNSGIFSEFLKLIVGNQADFKKYFNLDDQASLHESK
ESYDEDLETLLGHIGDDYSDVFLKAKKLYDAILLSGILTVTDNETEAPLSSAMIRYKEHEEDLALL
KAYIRNISLETYNEVFKDDTKNGYAGYIDGKTNQEDFYVYLKKLLTGLEGADYFLEKINREDLLRK
QRTFDNGSIPYQIHLQEMRAIIDKQAKFYPPFLAKNKERIEKILTFRIPYYVGPLARGNSDFAWSIRKR |

| SEQ ID NO | Nuclease Sequence |
|---|---|
| | NEKITPWNFEDVIDKESSAEAFINRMTSFDLYLPEEKVLPKHSLLYETFTVYNELTKVRFIAESMRD
YQFLDSKQKKDIVRLYFKGKRKVTDKDIIDYLHAIDGYDGIELKGIEKQFNSSLSTYHDLLNIINDKE
FLDDASNEAIIEEIIHTLTIFEDREMIKQRLSKFENIFDKSVLKKLSRRHYTGWGKLSAKLINGIRDEK
SGKTILDYLIDDGISNRNFMQLIHDDTLSFKKKIQKAQIIGDQDNIKQVVQSLPGSPAIKKGILQSIKI
VDELVKVMGRNPESIVVEMARENQYTNQGKSNSQQRLKRLEESLKELGSKILKENVPAKLSKIDN
NALQNERLYLYYLQNGKDMYTGKDLDIDRLSNYDIDHIIPQAFLKDNSIDNKVLVSSASNRGKSDD
VPSLDVVKKRKGFWHQLLKSKLISQRKFDNLTKAERGGLTEDDKAGFIKRQLVETRQITKHVAQIL
DSRFNTKRDDNDKVIRDVKIITLKSNLVSQFRKEFGLYKVREINDYHHAHDAYLNAVVATAILKKY
PKLEPEFVYGDYQKYDIKKYLASKDDSSLGKATAKMFFYSNLMNFFKKKVRLSDGTVLIRPVIEYS
KDTGEIAWNKEKDFATVRKVLSCPQVNIVKKTEVQTGGFSKESILPKRNSDKLIARKKDWDPKKY
GGFDSPTVAYSVLVVAKVEKGKSKKLKSVKELLGITIMERSSFEKNPIDFLEAKGYKEVRKDLIVKL
PKYSLFELENGRKRMLASAGELQKGNELALPSKYVNFLYLASHYEKLKGSPEDNEQKQLFVEQHK
HYLDEIIEQISEFSKRVILADANLDKVLSAYNKHRDKPIREQAENIIHLFTLTNLGAPAAFKYFDTTID
RKRYTSTKEVLDATFIHQSITGLYETRIDLSQLGGD |
| 110 | MNKPYSIGLDIGTNSVGWAVITDSYKVPSKKMKVLGNTSKKYVKKNLLGALLFESGITAEGRRLK
RTARRRYTRRRNRILYLQEIFSTEMNKIDEGFFQRLDDSFLVPDDKRDSKYPIFGNLVEEKTYHDEF
PTIYHLRKYLADSSKKADLRLVYLALAHMIKYRGHFLIEGDFNSRNNDIKKNFSKFLDSYNAIFESD
LSLENSEQVEEIVKDKISKSAKRERVLKLFPDEKSTGLFSEFLKLIVGNQADFKKHFDLEEKAPLQFS
KDTYEEDLESLLGQIGDIYADLFVVAKKLYDAILLAGILSVKDPSTKAPLSASMIERYDNHQNDLSA
LKQFIRRNLSEKYDEVFSDESKDGYAGYINGKTTQEAFYKYIKNLSKLEGADYFLDKIEREDFLRK
QRTFDNGSIPHQIHLQEMNAILRRQGEHYPFLKENKEKIEKILTFRIPYYVGPLARGNRDFAWLTRN
SDQAIRPWNFEEIVDQASSAEDFINKMTNYDLYLPEEKVLPKHSLLYETFAVYNELTKVKFIAEGLR
DYQFLDSGQKKQIVNQLFKEKRKVTEKDIIHYLHNVDGYDGIELKGIEKQFNASLSTYHDLLKIIKD
KEFMDDPKNEEILENIVHTLTIFEDREMIKQRLAQYDSLFDEKVIKALTRRHYTGWGKLSAKLINGI
CDKKTGKTILDYLIDDDKINRNFMQLIHDDGLSFKEIIQKAQVVGKTDDVKQVVQELPGSPAIKKGI
LQSIKLVDELVKVMGHAPESIVIEMARENQTTARGKKNSQQRYKRIEDALKNLAPGLDSNILKENP
TDNIQLQNDRLFLYYLQNGKDMYTGEALDINQLSSYDIDHIVPQAFIKDDSLDNRVLTSSKDNRGK
SDNVPSIEVVQKRKAFWQQLLDSKLISERKENNLTKAERGGLDERDKVGFIKRQLVETRQIITKHVA
QILDARFNTEVDENGKKIRKVKIITLKSNLVSNFRKEFRLYKVREINDYHHAHDAYLNAVVAKAIL
KKYPKLEPEFVYGDYQKYDIKRYISRSKDPKDIEKATEKYFFYSNLLNFFKEEVHYADGTIVKRENI
EYSKDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 111 | MTKPYSIGLDIGTNSVGWAVISDSYKVPSKKMKVLGNTSKKYVKKNLLGALLFESGITAEGRRLKR
TARRRYTRRRNRILYLQEIFSTEMAKIDESFFQRLDDSFLVPDDKRDSKYPIFGNLVEEKTYHDKFPT
IYHLRKYLADSSKKADLRLVYLALAHMIKYRGHFLIEGDFNSRNNDIKKNFQNFLDSYNAIFESDLS
LENSKQLEEIVKDKISKSAKRERVLKLFPDEKSTGLFSEFLKLIVGNQADFKKHFDLEEKAPLQFSK
DTYDEDLENLLGQIGDDFADLFLVAKKLYDAILLSGILTVTDPSTKAPLSASMIERYENHQKDLAAL
KQFIQNNLQEKYDEVFSDQSKDGYAGYIDGKTTQEAFYKYIKDLLNNVEGADYFLEKIEREDFLRK
QRTFDNGTIPYQIHLQEMKAILHNQGEYYPFLKENKEKIEKILTFRIPYYVGPLARGNRDFAWLTRN
SDQAIRPWNFEEIVDQASSAEDFINKMTNYDLYLPEEKVLPKHSLLYETFAVYNELTKVKFIAEGLR
DYQFLDSGQKKQIVNQLFKEKRKVTEKDIIQFLHNVDGYDGIELKGIEKQFNASLSTYHDLLKIIKD
KEFMDDPKNEEILENIVHTLTIFEDREMIKQRLAQYDSLFDEKVIKALTRRHYTGWGKLSAKLINGI
YDKQSKKTILDYLIDDGEINRNFMQLINDDGLSFKEIIQKAQVVGKTDDVKQVVQELPGSPAIKKGI
LQSIKLVDELVKVMGDDPESIVIEMARENQTTARGKKNSQQRYKRIEDALKNLAPGLDSNILKEHP
TDNIQLQNDRLFLYYLQNGKDMYTGEALDINQLSNYDIDHIVPQAFIKDDSLDNRVLTSSKDNRGK
SDNVPSIEVVQKRKAFWQQLLDSKLISEHKFNNLTKAERGGLDERDKVGFIKRQLVETRQITKHVA
QILDARFNTEVNDKNQKIRSVKIITLKSNLVSNFRKEFGLYKVREINDYHHAHDAYLNAVVAKAIL
KKYPKLEPEFVYGDYQKYDLKRYISKSKEPKDIEKATEKYFFYSNLLNFFKEEVHYADGTIIKRENI
EYSKDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 112 | MNKPYSIGLDIGTNSVGWAVITDSYKVPSKKMKVLGNTSKKYVKKNLLGALLFESGITAEGRRLK
RTARRRYTRRRNRILYLQEIFSTEMAKVDESFFQRLDDSFLVPDDKRDSKYPIFGNLVEEKTYHEEF
PTIYHLRKYLADSSKKADLRLVYLALAHMIKYRGHFLIEGDFNSRNNDIKKNFQDFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPNTKAPLSASMIERYENHEEDLA
ALKQFIKNNLPEKYDEVFSDQSKDGYAGYINGKTTQEAFYKYIKNLSKFEGADYFLDKIEREDFL
RKQRTFDNGSIPHQIHLQEMNAILRRQGEHYPFLKENKEKIEKILTFRIPYYVGPLARGNRDFAWLT
RNSDQAIRPWNFEEVVDKASSAEDFINKMTNYDLYLPEEKVLPKHSLLYETFAVYNELTKVKFIAE
GLRDYQFLDSGQKKQIVNQLFKEKRKVTEKDIIQFLHNVDGYDGIELKGIEKQFNASLSTYHDLLKI
IKDKEFMDDPKNEEILENIVHTLTIFEDREMIKQRLAQYDSLFDEKVIKALTRRHYTGWGKLSAKLI
NGICDKQTGNTILDYLIDDDKINRNFMQLINDDGLSFKEIIQKAQVVGKTNDVKQVVQELPGSPAIK
KGILQSIKLVDELVKVMGHEPEQIVIEMARENQTTNQGKRNSQQRYKRIEDGVKNLASDLNGNILK
EYPTDNQALQNDRLFLYYLQNGKDMYTGEPLDINQLSNYDIDHIVPQAFIKDDSLDNRVLTSSKDN
RGKSDNVPSIEVVQKRKAFWQQLLDSKLISERKENNLTKAERGGLDERDKVGFIRRQLVETRQITK
HVAQILDARFNTEVDDTGKRIRKVKIITLKSNLVSNFRKEFGLYKVREINDYHHAHDAYLNAVVAK |

Sequences

| SEQ ID NO | Nuclease Sequence |
|---|---|
| | AILKKYPKLEPEFVYGDYQKYDVKRYISRSKDPKDIEKATEKYFFYSNLLNFFKEEVHYADGTIIKR
ENIEYSKDTGEIAWNKEKDFATVRKVLSCPQVNIVKKTEVQTGGFSKESILPKRNSDKLIARKKDW
DPKKYGGFDSPTVAYSVLVVAKVEKGKSKKLKSVKELLGITIMERSSFEKNPIDFLEAKGYKEVRK
DLIVKLPKYSLFELENGRKRMLASAGELQKGNELALPSKYVNFLYLASHYEKLKGSPEDNEQKQLF
VEQHKHYLDEIIEQISEFSKRVILADANLDKVLSAYNKHRDKPIREQAENIIHLFTLTNLGAPAAFKY
FDTTIDRKRYTSTKEVLDATFIHQSITGLYETRIDLSQLGGD |
| 113 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVKEKTYHDEF
PTIYHLRKYLADSSKKADLRLVYLALAHMIKYRGHFLIEGDFNSRNNDIKKNFQNFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLSA
LKQFIRSNLSEKYDEVFSDQSKDGYAGYINGKTTQEAFYKYIKNLLSKFEGADYFLDKIEREDFLRK
QRTFDNGSIPHQIHLQEMNAIIRRQGEHYPFLKENKEKIEKILTFRIPYYVGPLARGNRDFAWLTRNS
DQAIRPWNFEEVVDKASSAEAFINKMTNFDLYLPEEKVLPKHSLLYETFAVYNELTKVKFIAEGLR
DYQFLDSGQKKQIVNQLFKEKRKVTEKDIIQFLHNVDGYDGIELKGIEKQFNASLATYHDLLKIIKD
KEFMDDPKNEEILENIIHTLTIFEDREMIKQRLAQYDSLFDEKVIKALTRRHYTGWGKLSAKLINGIC
DKQTGKTILDYLIDDGFANRNFMQLINDDTLPFKQIIQKAQIVGDVDDIEQVVHNLPGSPAIKKGIL
QSIKIVDELVKVMGHNPDNIVIEMARENQTTNRGRSQSQQRLKKLQESLKELGSNILNEEKPSYVES
KVENSQLQNDRLFLYYIQNGKDMYTGEELDIDRLSDYDIDHIIPQAFIKDDSIDNRVLTSSAKNRGK
SDDVPSLEVVKKRKTYWHQLLKAKLISQRKFDNLTKAERGGLTEKDKAGFIKRQLVETRQITKHV
AQILDSRFNTKRDENDKVIRDVKVITLKSNLVSQFRKDFGFYKVREINDYHHAHDAYLNAVVGTA
LLKKYPKLAPEFVYGEYKKYDVRKIVRSKDESSLGKATAKMFFYSNLMNFFKKEVRLSDGTVIVR
PVIEYSKDTGEIAWNKEKDFATVRKVLSCPQVNIVKKTEVQTGGFSKESILPKRNSDKLIARKKDW
DPKKYGGFDSPTVAYSVLVVAKVEKGKSKKLKSVKELLGITIMERSSFEKNPIDFLEAKGYKEVRK
DLIVKLPKYSLFELENGRKRMLASAGELQKGNELALPSKYVNFLYLASHYEKLKGSPEDNEQKQLF
VEQHKHYLDEIIEQISEFSKRVILADANLDKVLSAYNKHRDKPIREQAENIIHLFTLTNLGAPAAFKY
FDTTIDRKRYTSTKEVLDATFIHQSITGLYETRIDLSQLGGD |
| 114 | MKKPYSIGLDIGTNSVGWAVITDDYKVPSKKMKVLGNTSKKYVKKNLLGALLFESGITAEGRRLK
RTARRRYTRRRNRILYLQEIFETGMKEIDESFFQRLDDSFLVPDDKRDSKYPIFGNLAQEKTYHDEF
PTIYHLRKYLADSSKKADLRLVYLALAHMIKYRGHFLIEGDFNSRNNDIKKNFQNFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLA
ALKQFIQNNLQEKYDEVFSDQSKDGYAGYIDGKTTQEAFYKYIKNTLSKIEGSDYFLDKIEREDFLR
KQRTFDNGSIPHQIHLQEMNAIIRRQGEHYPFLQENKEKIEKILTFRIPYYVGPLARGNRDFAWLTR
NSDQAIRPWNFEEVVDQASSAEDFINKMTNYDLYLPEEKVLPKHSLLYETFAVYNELTKVKFIAEG
LRDYQFLDSGQKKQIVNQLFKEKRKVTEKDIIHYLHNVDGYDGIELKGIEKQFNASLSTYHDLLKII
RDKDFMDDPKNEEILENIVHTLTIFEDREMIKQRLAQYDSIFDEKVIKALARRHYTGWGRLSAKLIN
GIRDKQSKKTILDYLIDDDKINRNFMQLINDDGLSFKEIIQKAQVVGKTDDVKQVVQELPGSPAIKK
GILQSIKIVDELVKVMGYDPEQIVIEMARENQTTNQGRRNSQQRYKLIEDGVKNLASDLNGNILKE
YPTDNQALQNDRLFLYYLQNGKDMYTGEPLDINQLSSYDIDHIIPQAFIKDDSLDNRVLTSSKDNR
GKSDNVPSIEVVQKRKAFWQQLLDSKLISERKENNLTKAERGGLDERDKVGFIKRQLVETRQITKH
VAQILDARFNTEVNEKKQKIRSVKIITLKSNLVSNFRKEFGLYKVREINDYHHAHDAYLNAVVAKA
ILKKYPKLEPEFVYGDYQKYDIKRYISRSKDPKDIEKATEKYFFYSNLLNFFKEEVHYADGTIVKRE
NIEYSKDTGEIAWNKEKDFATVRKVLSCPQVNIVKKTEVQTGGFSKESILPKRNSDKLIARKKDWD
PKKYGGFDSPTVAYSVLVVAKVEKGKSKKLKSVKELLGITIMERSSFEKNPIDFLEAKGYKEVRKD
LIVKLPKYSLFELENGRKRMLASAGELQKGNELALPSKYVNFLYLASHYEKLKGSPEDNEQKQLFV
EQHKHYLDEIIEQISEFSKRVILADANLDKVLSAYNKHRDKPIREQAENIIHLFTLTNLGAPAAFKYF
DTTIDRKRYTSTKEVLDATFIHQSITGLYETRIDLSQLGGD |
| 115 | MTKPYSIGLDIGTNSVGWAVISDSYKVPSKKMKVLGNTSKKYVKKNLLGALLFESGITAEGRRLKR
TARRRYTRRRNRILYLQEIFSTEMAKIDESFFQRLDDSFLVPDDKRDSKYPIFGNLVEEKVYHDEFPT
IYHLRKYLADSQKKADLRLVYLALAHMIKYRGHFLIEGDFNSRNNDIKKNFQNFLDSYNAIFESDL
SLENSKQLEEIVKDKISKSAKRERVLSLFPDEKSTGLFSEFLKLIVGNQADFKKHFELEEKAPLQFSK
DTYDEDLENLLGQIGDDFADLFLVAKKLYDAILLSGILTVTDPSTKAPLSASMIERYENHQKDLAQL
KQFVKTNLPEKYDEVFSDQSKDGYAGYIDGKTTQEAFYKYIKETLNKVEGADYFLDKIERENFLRK
QRTFDNGSIPHQIHLQEMNAILHRQGEHYPFLKENKEKIEKILTFRIPYYVGPLARGNRDFAWLTRN
SDQAIRPWNFEEVVDQASSAEEFINKMTNYDLYLPEEKVLPKHSLLYETFAVYNELTKVKFIAEGL
RDYQFLDSGQKKQIVNQLFKEKRKVTEKDIIQFLHNVDGYDGIELKGIEKQFNASLSTYHDLLKIIK
DKEFMDDPKNEEILENIIHTLTIFEDREMIKQRLAQYDTLFDEKVIKALTRRHYTGWGKLSAKLINGI
CDKQTGDTILDFLIDDDKINRNFMQLINDDGLSFKDIIQKAQVVGKTDDVKQVVQELPGSPAIKKGI
LQSIKIVDELVKVMGHAPESIVIEMARENQTTARGKKNSQQRYKRIEDALKNLAPGLDSNILKENPT
DNIQLQNDRLFLYYLQNGKDMYTGEPLDINQLSSYDIDHIVPQAFIKDDSLDNRVLTSSKDNRGKS
DNVPSIEVVQKRKAFWQQLLDSKLISERKENNLTKAERGGLDERDKVGFIRRQLVETRQITKHVAQ
ILDARFNTEVDSKGKKIRKVKIITLKSNLVSNFRKEFGLYKVREINDYHHAHDAYLNAVVAKAILK
KYPKLEPEFVYGDYQKYDVKRYISRSKDPKEVEKATQKYFFYSNLLNFFKEEVHYADGTIIKRENIE
YSKDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |

-continued

Sequences

| SEQ ID NO | Nuclease Sequence |
|---|---|
| 116 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSTKKADLRLVYLALAHMIKYRGHFLIEGDFNSRNNDIKKNFQDFLDSYNAIFESD<br>LSLENSKQLEEIVKDKISKSAKKDRLLKLFPGEKNSGIFSEFLKLIVGNQADFKKYFNLDEKAPLHES<br>KESYDEDLETLLGHIGDDYSDVFLKAKKLYDAILLSGILTVTDNETEAPLSSAMIRYKEHEEDLAL<br>LKAYIRKISLETYNEVFKDDTKNGYAGYIDGKTSQEDFYVHLKKLLTGLEGADYFLEKINREDLLR<br>KQRTFDNGSIPYQIHLQEMRAILDKQAKFYPPLAKNKERIEKILTFRIPYYVGPLARGNSDFAWSIRK<br>RNEKITPWNFEDVIDKESSAEAFINRMTSFDLYLPEEKVLPKHSLLYETFTVYNELTKVRFIAESMR<br>DYQFLDSKQKKDIVRLYFKGKRKVTDKDIIDYLHAIDGYDGIELKGVEDQFNASLSTYHDLLNIIND<br>KEFLDDSSNEAIIEEIIHTLTIFEDREMIKQRLSKYEDIFGKSVLKKLSRRHYTGWGKLSAKLINGIRD<br>EKSGKTILDYLIDDGISNRNFMQLIHDDTLSFKKKIQKAQIIGDQDNIKQVVQSLPGSPAIKKGILQSI<br>KIVDELVKVMGRRPESIVVEMARENQYTNQGKSNSQQRLKRLEESLKELGSKILKENVPAKLSKID<br>NNALQNERLYLYYLQNGKDMYTGDDLDIDRLSNYDIDHIIPQAFLKDNSIDNKVLVSSASNRGKSD<br>DVPSLDVVKKRKTFWHQLLKSQLISQRKFDNLTKAERGGLSPEDKAGFIQRQLVETRQITKHVARL<br>LDERFNNEKDEDNKALRTVKIITLKSSLVSQFRKDFELYKVREINDFHHAHDAYLNAVVATALLKK<br>YPKLEPEFVYGDYPKYNSYKSRKSATEKVLFYSNIMNFFKRLVRLSDGRVLIRPVIEYSKDTGEVA<br>WNKEKDFATVRKVLSCPQVNIVKKTEVQTGGFSKESILPKRNSDKLIARKKDWDPKKYGGFDSPT<br>VAYSVLVVAKVEKGKSKKLKSVKELLGITIMERSSFEKNPIDFLEAKGYKEVRKDLIVKLPKYSLFE<br>LENGRKRMLASAGELQKGNELALPSKYVNFLYLASHYEKLKGSPEDNEQKQLFVEQHKHYLDEII<br>EQISEFSKRVILADANLDKVLSAYNKHRDKPIREQAENIIHLFTLTNLGAPAAFKYFDTTIDRKRYTS<br>TKEVLDATFIHQSITGLYETRIDLSQLGGD |
| 117 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKAYHDEF<br>PTIYHLRKYLADSSKKADLRLVYLALAHMIKYRGHFLIEGDFNSRNNDIKKQFQDFLDSYNAIFESS<br>LSLEQSEQVEEIVKDKISKSAKRERVLKLFPDEKSTGLFSEFLKLIVGNQADFKKHFDLEEKAPLQFS<br>KDTYDEDLENLLGQIGDGFADLFLVAKKLYDAILLSGILTVTDPSTKAPLSASMIERYENHQKDLA<br>ALKQFIQNNLQEKYDEVFSDQSKDGYAGYIDGKTTQEAFYKYIKNLLSKFEGADYFLEKIEREDFL<br>RKQRTFDNGSIPHQIHLQEMNAIIRRQGEHYPPLKENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEGL<br>RDYQFLDSGQKKQIVNQLFKEKRKVTEKDIIHYLHNVDGYDGIELKGIEKQFNASLSTYHDLLKIIK<br>DKEFMDDPKNEEILENIVHTLTIFEDREMIKQRLAQYDSLFDEVIKALTRRHYTGWGKLSAKLING<br>ICDKKTGNTILDYLIDDDKINRNFMQLINDDSLSFKDIIQKAQVVGKTDDVKQVVQELPGSPAIKKG<br>ILQSIKIVDELVKVMGHAPESIVIEMARENQTTNQGRRNSQQRYKRIEEAIKNLSVDLDSKILKEYPT<br>DNQALQNDRLFLYYLQNGKDMYTGEPLDINQLSNYDIDHIVPQAFIKDDSLDNRVLTSSKDNRGKS<br>DNVPSLEIVQKRKAFWQQLLDSKLISERKENNLTKAERGGLDERDKVGFIRRQLVETRQITKHVAQ<br>ILDARFNTEVNDKGQKIRKVKIITLKSNLVSNFRKEFGLYKVREINDYHHAHDAYLNAVVAKAILK<br>KYPKLEPEFVYGDYQKYDIKRYISRSKDPKDIEKATEKYFFYSNLLNFFKEEVHYADGTIIKRENVE<br>YSNDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 118 | MNKPYSIGLDIGTNSVGWAVITDSYKVPSKKMKVLGNTSKKYVKKNLLGALLFESGITAEGRRLK<br>RTARRRYTRRRNRILYLQEIFGTEMNEIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQEFLDSYNAIFESDL<br>SLENSKQLEEIVKDKISKSAKRERVLKLFPDEKSTGLFSEFLKLIVGNQAEFKKHFDLEEKAPLQFSK<br>DTYDEDLENLLGQIGDDFADLFLVAKKLYDAILLSGILTVTDPSTKAPLSASMIERYENHQKDLAAL<br>KQFVKNNLPEKYDEVFSDQSKDGYAGYIDGKTTQEAFYKYIKNLLSKFEGADYFLEKIEREDFLRK<br>QRTFDNGSIPHQIHLQEMQAILHRQGEYYPPLKENREKIEKILTFRIPYYVGPLARGNRDFAWLTRN<br>SDQAIRPWNFEEVVDQASSAEEFINKMTNYDLYLPEEKVLPKHSLLYETFAVYNELTKVKFIAEGL<br>RDYQFLDSGQKKQIVNQLFKEKRKVTEKDIIHYLHNVDGYDGIELKGIEKQFNASLSTYHDLLKIIK<br>DKEFMDDAKNEEILENIVHTLTIFEDREMIKQRLAQYDSLFDEKVIKALTRRHYTGWGKLSAKLIN<br>GICDKQTGDTILDYLIDDDKINRNFMQLINDDGLSFKEIIQKAQVFGKTDDVKQVVQELPGSPAIKK<br>GILQSIKIVDELVKVMGHAPESIVIEMARENQTTNQGKRNSQQRYKRIEDGVKNLASDLNGNILKE<br>YPTNNQALQNDRLFLYYLQNGKDMYTGESLDINQLSSYDIDHIIPQAFIKDDSIDNRVLTSSKDNRG<br>KSDNVPSLEVVQKRKAFWQQLLDSKLISERKFNNLTKAERGGLDERDKVGFIKRQLVETRQITKHV<br>AQILDARFNTEVDENNQKIRKVKIITLKSNLVSNFRKEFGLYKVREINDYHHAHDAYLNAVVAKAI<br>LKKYPKLEPEFVYGDYQKYDLKRYISKSKDPKDIEKATEKFFFYSNLLNFFKEKVTYADGTIKKRE<br>NIEYSNDTGEIAWNKEKDFATVRKVLSCPQVNIVKKTEVQTGGFSKESILPKRNSDKLIARKKDWD<br>PKKYGGFDSPTVAYSVLVVAKVEKGKSKKLKSVKELLGITIMERSSFEKNPIDFLEAKGYKEVRKD<br>LIVKLPKYSLFELENGRKRMLASAGELQKGNELALPSKYVNFLYLASHYEKLKGSPEDNEQKQLFV<br>EQHKHYLDEIIEQISEFSKRVILADANLDKVLSAYNKHRDKPIREQAENIIHLFTLTNLGAPAAFKYF<br>DTTIDRKRYTSTKEVLDATFIHQSITGLYETRIDLSQLGGD |
| 119 | MTKPYSIGLDIGTNSVGWAVITDDYKVPSKKMKVLGNTSKKYVKKNLLGALLFESGITAEGRRLK<br>RTARRRYTRRRNRILYLQEIFSTEMNKIDESFFQRLDDSFLVPDDKRDSKYPIFGNLAQEKTYHDEF<br>PTIYHLRKYLADSSKKADLRLVYLALAHMIKYRGHFLIEGDFNSRNNDIKKNFQEFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDGFADLFLVAKKLYDAILLSGILTVTDPSTKAPLSASMIERYENHQKDLA<br>ALKQFVRTNLPEKYDEVFSDQSKDGYAGYIDGKTTQEAFYKYLKKLLTGLEGADYFLEKIEREDFL<br>RKQRTFDNGTIPYQLHLEELKAIIHNQGEYYPFLQENKEKIEKILTFRIPYYVGPLARGNRDFAWLT |

| SEQ ID NO | Nuclease Sequence |
|---|---|
| | RNSDQAIRPWNFEEVVDQASSAEDFINKMTNYDLYLPEEKVLPKHSLLYETFAVYNELTKVKFIAE<br>GLRDYQFLDSGQKKQIVNQLFKEKRKVTEKDIIHYLHNVDGYDGIELKGIEKQFNASLSTYHDLLKI<br>IKDKEFMDDPKNEEILENIVHTLTIFEDREMIKQRLAQYDSLFDEKVIKALTRRHYTGWGKLSAKLI<br>NGICDKQTGDTILDYLIDDDKINRNFMQLINDDGLSFKEIIQKAQVVGKTDDVKQVVQELPGSPAIK<br>KGILQSIKIVDELVKVMGHAPESIVIEMARENQTTARGKKNSQQRYKRIEDALKNLAPGLDSNILKE<br>HPTDNIQLQNDRLFLYYLQNGKDMYTGEPLDINQLSSYDIDHIVPQAFIKDDSLDNRVLTSSKDNR<br>GKSDNVPSLEVVQKRKAFWQQLLDSKLISERKENNLTKAERGGLDERDKVGFIRRQLVETRQITKH<br>VAQILDARFNTEVNEKGKKIRKVKIITLKSNLVSNFRKEFGLYKVREINDYHHAHDAYLNAVVAK<br>AILKKYPKLEPEFVYGDYQKYDLKRYISKSKDPKEVEKATQKYFFYSNLLNFFKEEVHYADGTIIK<br>RENIEYSKDTGEIAWNKEKDFATVRKVLSCPQVNIVKKTEVQTGGFSKESILPKRNSDKLIARKKD<br>WDPKKYGGFDSPTVAYSVLVVAKVEKGKSKKLKSVKELLGITIMERSSFEKNPIDFLEAKGYKEVR<br>KDLIVKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDATFIHQSITGLYETRIDLSQLGGD |
| 120 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKVDESFFQRLDDSFLVPDDKRDSKYPIFGNLVQEKTYHDEF<br>PTIYHLRKYLADSSKKADLRLVYLALAHMIKYRGHFLIEGDFNSKNNDIKKNFQEFLDSYNAIFESD<br>LSLENNAQVEEIVKDKISKSAKRERVLKLFPDEKSTGLFSEFLKLIVGNQADFKKHFDLEEKAPLQF<br>SKDTYDEDLENLLGQIGDGFADLFLVAKKLYDAILLSGILTVTDPSTKAPLSASMIERYENHQKDLA<br>ALKQFVKANLPEKYDEVFSDQSKDGYAGYIDKTTQEAFYKYIKNLLAKFEGADYFLEKIEREDFL<br>RKQRTFDNGVIPYQVHLTEMRAILHRQGEYYPFLKENREKIEKILTFRIPYYVGPLARGNRDFAWLT<br>RNSDQAIRPWNFEEIVDKASSAEDFINKMTNYDLYLPEEKVLPKHSLLYETFAVYNELTKVKFIAEG<br>LRDYQFLDSGQKKQIVNQLFKEKRKVTEKDIIHYLHNVDGYDGIELKGIEKQFNASLSTYHDLLKII<br>KDKFMDDPKNEEILENIVHTLTIFEDREMIKQRLAQYDSLFDEKVIKALTRRHYTGWGKLSAKLI<br>NGICDKQTGDTILDYLIDDDKINRNFMQLINDDGLSFKEIIQKAQVVGKTDDVKQVVQELPGSPAIK<br>KGILQSIKIVDELVKVMGHAPESIVIEMARENQTTNQGKRNSQQRYKKIEDAIKNLDSNLNSKILKE<br>YPTNNQALQNDRLFLYYLQNGKDMYTGEELDINQLSNYDIDHIIPQAFIKDDSLDNRVLTSSKDNR<br>GKSDNVPSIEVVQKRKAFWQQLLDSKLISERKENNLTKAERGGLDERDKVGFIKRQLVETRQITKH<br>VAQILDARFNTEVDENGKRIRKVKIITLKSNLVSNFRKEFGLYKVREINDYHHAHDAYLNAVVAKA<br>ILKKYPKLEPEFVYGDYQKYDIKRYISRSKDPKEVEKATEKYFFYSNLLNFFKEEVTYADGTIKKRE<br>NIEYSNDTGEIAWNKEKDFATVRKVLSCPQVNIVKKTEVQTGGFSKESILPKRNSDKLIARKKDWD<br>PKKYGGFDSPTVAYSVLVVAKVEKGSKSKKLKSVKELLGITIMERSSFEKNPIDFLEAKGYKEVRKD<br>LIVKLPKYSLFELENGRKRMLASAGELQKGNELALPSKYVNFLYLASHYEKLKGSPEDNEQKQLFV<br>EQHKHYLDEIIEQISEFSKRVILADANLDKVLSAYNKHRDKPIREQAENIIHLFTLTNLGAPAAFKYF<br>DTTIDRKRYTSTKEVLDATFIHQSITGLYETRIDLSQLGGD |
| 121 | MTKPYSIGLDIGTNSVGWAVITDNYKVPSKKMKVLGNTSKKYVKKNLLGALLFESGITAEGRRLK<br>RTARRRYTRRRNRILYLQEIFSTEMSKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQNFLDSYNAIFESDL<br>SLENSEQLEEIVKDKISKSAKRERVLKLFPDEKSTGLFSEFLKLIVGNQAEFKKHFDLEEKAPLQFSK<br>DTYDEDLENLLGQIGDDFADLFLVAKKLYDAILLSGILTVTDPSTKAPLSASMIERYENHQKDLAAL<br>KQFIQNNLQEKYDEVFSDQSKDGYAGYIDGKTTQEAFYKYIKNLLSKLEGADYFLDKIEREDFLRK<br>QRTFDNGSIPHQIHLQEMNAILRRQGEHYPFLKENKEKIEKILTFRIPYYVGPLARGNRDFAWLTRN<br>SDQAIRPWNFEEIVDQASSAEDFINKMTNYDLYLPEEKVLPKHSLLYETFAVYNELTKVKFIAEGLR<br>DYQFLDSGQKKQIVNQLFKDRKVTEKDIIHYLHNVDGYDGIELKGIEKQFNASLSTYHDLLKIIKD<br>KEFMDDPKNEEILENIVHTLTIFEDREMIKQRLAQYDSLFDEKVIKALTRRHYTGWGKLSAKLINGI<br>CDKQTGDTILDYLIDDDKINRNFMQLINDDGLSFKEIIQKAQVVGKTDDVKQVVQELPGSPAIKKGI<br>LQSIKIVDELVKVMGHAPESIVIEMARENQTTNQGKRNSQQRYKRIEDGIKNLASDLNGNILKEYPT<br>DNQALQNDRLFLYYLQNGKDMYTGEPLDINQLSNYDIDHIVPQAFIKDDSLDNRVLTSSKDNRGKS<br>DNVPSLEVVQKRKAFWQQLLDSQLISQRKFDNLTKAERGGLTDHDKAGFIKRQLVETRQITKHVA<br>QILDARFNTEVTEKDKKIRNVKIITLKSNLVSNFRKEFGLYKVREINDYHHAHDAYLNAVVAKAIL<br>KKYPKLEPEFVYGDYQKYDIKRYISRSKDPKDIDKATEKYFFYSNLLNFFKEEVHYADGTIVKRENI<br>EYSKDTGEIAWNKEKDFATVRKVLSCPQVNIVKKTEVQTGGFSKESILPKRNSDKLIARKKDWPK<br>KYGGFDSPTVAYSVLVVAKVEKGSKSKKLSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 122 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIKSNLSEKYDEVFSDQSKDGYAGYIDKTTQEAFYKYIKNLLSKLEGSDYFLDKIEREDFLR<br>KQRTFDNGSIPHQIHLQEMNAIIRRQGEHYPFLKENKEKIEKILTFRIPYYVGPLARGNRDFAWLTR<br>NSDQAIRPWNFEEVVDKASSAEDFINKMTNYDLYLPEEKVLPKHSLLYETFAVYNELTKVKFIAEG<br>LRDYQFLDSGQKKQIVNQLFKEKRKVTEKDIIQYLHNVDGIELKGIEKQFNASLSTYHDLLKII<br>KDKFMDDPKNEEILENIVHTLTIFEDREMIKQRLAQYDSLFDEKVIKALTRRHYTGWGKLSAKLI<br>DGIYDKQSRKTILDYLIDDGEINRNFMQLIHDDGLSFKEIIQKAQVVGETDNLKQVVQELPGSPAIK<br>KGILQSIKIVDELVKVMGHAPESIVIEMARENQTTARGKKNSQQRYKRIEDALKNLAPGLDSNILKE<br>NPTDNVQLQNDRLFLYYLQNGKDMYTGEPLDINQLSSYDIDHIVPQAFIKDDSLDNRVLTSSKDNR<br>GKSDNVPSLEVVQKRKAFWQQLLDSKLISQRKFDNLTKAERGGLTENDKAGFIKRQLVETRQITK<br>HVAQILDARFNTEVNENNQKIRKVKIITLKSNLVSNFRKEFGLYKVREINDYHHAHDAYLNAVVA |

| SEQ ID NO | Nuclease Sequence |
|---|---|
| | KAILKKYPKLEPEFVYGDYQKYDIKRYISRSKDPKDIEKATEKYFFYSNLLNFFKEEVHYADGTIIK<br>RENIEYSNDTGEIAWNKEKDFATVRKVLSCPQVNIVKKTEVQTGGFSKESILPKRNSDKLIARKKD<br>WDPKKYGGFDSPTVAYSVLVVAKVEKGKSKKLKSVKELLGITIMERSSFEKNPIDFLEAKGYKEVR<br>KDLIVKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDATFIHQSITGLYETRIDLSQLGGD |
| 123 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAEIDESFFQRLDDSFLVPDDKRDSKYPIFGNLVKEKTYHDEFP<br>TIYHLRKYLADSTKKADLRLVYLALAHMIKYRGHFLIEGDFNSRNNDIKKNFQDFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>QLKQFVKTNLPEKYDEVFSDQSKDGYAGYINGKTTQEAFYKYIKNLLSKLEGADYFLDKIEREDFL<br>RKQRTFDNGSIPHQIHLQEMNAILHRQGEHYPFLKENKEKIQQLLTFRIPYYVGPLARGNRDFAWL<br>TRNSDQAIRPWNFEEIVDKASSAEDFINKMTNYDLYLPEEKVLPKHSLLYETFAVYNELTKVKFIAE<br>GLRDYQFLDSGQKKQIVNQLFKEKRKVTEKDIIHYLHNVDGYDGIELKGIEKQFNASLSTYHDLLKI<br>IKDKDFMDDPKNEEILENIVHTLTIFEDREMIKQRLAQYDTLFDEKVIKALARRHYTGWGKLSAKLI<br>NGIYDKQSKKTILDYLIDDDKINRNFMQLINDDGLSFKDIIQKAQVVGKTDDVKQVVQELPGSPAIK<br>KGILQSIKLVDELVKVMGHAPESIVIEMARENQTTARGKKNSQQRYKRIEDALKNLAPGLDSNILK<br>ENPTDNIQLQNDRLFLYYLQNGKDMYTGEALDINQLSNYDIDHIVPQAFIKDDSLDNRVLTSSKDN<br>RGKSDNVPSLEVVQKRKAFWQQLLDSKLISERKENNLTKAERGGLDERDKVGFIKRQLVETRQITK<br>HVAQILDARFNTEVNEKKQKIRNVKIITLKSNLVSNFRKEFGLYKVREINDYHHAHDAYLNAVVA<br>KAILKKYPKLEPEFVYGDYQKYDIKRYISRSKDPKDIEKATQKYFFYSNLLNFFKEEVHYADGTIVK<br>RENVEYSNDTGEIAWNKEKDFATVRKVLSCPQVNIVKKTEVQTGGFSKESILPKRNSDKLIARKKD<br>WDPKKYGGFDSPTVAYSVLVVAKVEKGKSKKLKSVKELLGITIMERSSFEKNPIDFLEAKGYKEVR<br>KDLIVKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDATFIHQSITGLYETRIDLSQLGGD |
| 124 | MKKPYSIGLDIGTNSVGWAVITDDYKVPSKKMKVLGNTSKKYVKKNLLGALLFESGITAEGRRLK<br>RTARRRYTRRRNRILYLQEIFSTEMSKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQNFLDSYNAIFESDL<br>SLENSKQLEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLAAL<br>KQFIQNNLQEKYDEVFSDQSKDGYAGYIDGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEIVDKASSAEDFINKMTNYDLYLPEEKVLPKHSLLYETFAVYNELTKVKFIAEGLR<br>DYQFLDSGQKKQIVNQLFKEKRKVTEKDIIHYLHTVDGYDGIELKGIEKQFNASLSTYHDLLKIIKD<br>KEFMDDPKNEEILENIIHTLTIFEDREMIKQRLAQYDSLFDEKVIKALTRRHYTGWGKLSAKLINGIR<br>DDKSGNTILDYLIDDDKINRNFMQLIHDDGLSFKEIIQKAQVFGKTDDVKQVVQELPGSPAIKKGIL<br>QSIKIVDELVKVMGHAPESIVIEMARENQTTNQGKRNSQQRYKRIEEGIKNLASELNGNILKEYPTN<br>NQALQNERLFLYYLQNGRDMYTGKSLDINQLSNYDIDHIIPQAFIKDDSLDNRVLTSSKDNRGKSD<br>NVPSIEVVEKMKAFWQQLLDSKLISERKENNLTKAERERGGLNELDKVGFIKRQLVETRQITKHVA<br>QILDARFNTEVNEKKQKIREVKIITLKSNLVSNFRKEFGLYKVREINDYHHAHDAYLNAVVAKAIL<br>KKYPKLEPEFVYGDYQKYDIKRYISRSKDPKEIEKATEKYFFYSNLLNFFKEEVHYADGTIVKRENI<br>EYSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 125 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKVDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKRERVLKLFPDEKSTGLFSEFLKLIVGNQAEFKKHFDLEEKAPLQFS<br>KDTYDEDLENLLGQIGDDFADLFLVAKKLYDAILLSGILTVTDPSTKAPLSASMIERYENHQKDLAT<br>LKQFIKNNLSEKYDEVFSDQSKDGYAGYIDGKTTQEAFYKYIKNLLSKLEGADYFLDKIEREDFLR<br>KQRTFDNGSIPHQIHLQEMNAILRRQGEHYPFLKENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEGL<br>RDYQFLDSGQKKQIVNQLFKEKRKVTEKDIIHYLHNVDGYDGIELKGIEKQFNASLSTYHDLLKIIK<br>DKEFMDDPKNEEILENIVHTLTIFEDREMIKQRLAQYDSLFDEKVIKALTRRHYTGWGKLSAKLING<br>IYDKQSKKTILDYLIDDDKINRNFMQLIHDDGLSFKDIIQKAQVVGKTDDVKQVVQELPGSPAIKKG<br>ILQSIKIVDELVKVMGHAPESIVIEMARENQTTARGKKNSQQRYKRIEDALKNLAPGLDSNILKENP<br>TDNIQLQNDRLFLYYLQNGKDMYTGEPLDINQLSSYDIDHIVPQAFIKDDSLDNRVLTSSKDNRGK<br>SDNVPSLEVVQKRKGFWQQLLDSKLISERKENNLTKAERGGLDERDKVGFIKRQLVETRQITKHVA<br>QILDARFNTEVNEKNQKIRTVKIITLKSNLVSNFRKEFRLYKVREINDYHHAHDAYLNAVVAKAIL<br>KKYPKLEPEFVYGDYQKYDVRRYLSSKDSKDFGKATAKMFFYSNLLNFFKKEVRLADGTVIVRPV<br>IEYSKDTGEIAWNKEKDFATVRKVLSCPQVNIVKKTEVQTGGFSKESILPKRNSDKLIARKKDWDP<br>KKYGGFDSPTVAYSVLVVAKVEKGKSKKLKSVKELLGITIMERSSFEKNPIDFLEAKGYKEVRKDL<br>IVKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |

-continued

| SEQ ID NO | Nuclease Sequence |
|---|---|
| 126 | MKKPYSIGLDIGTNSVGWAVVTDDYKVPAKKMKVLGNTDKSHIKKNLLGALLFESGETAEGRRL<br>KRTARRRYTRRRNRILYLQEIFATEMNKIDESFFQRLDDSFLVPDDKRDSKYPIFGNLAQEKTYHEK<br>FPTIYHLRKYLADSSKKADLRLVYLALAHMIKYRGHFLIEGDFNSRNNDIKKNFQNFLDSYNAIFES<br>DLSLENSKQLEEIVKDKISKSAKRERVLKLFPDEKSTGLFSEFLKLIVGNQADFKKHFDLEEKAPLQF<br>SKDTYDEDLENLLGQIGDDFADLFLVAKKLYDAILLSGILTVTDPSTKAPLSASMIERYENHQKDLA<br>TLKQFIKNNLSEKYDEVFSDQSKDGYAGYIDKTTQEAFYKYIKNLLSKLEGADYFLDKIEREDFL<br>RKQRTFDNGSIPHQIHLQEMNAIIRRQGEHYPFLQENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEGL<br>RDYQFLDSGQKKQIVNQLFKEKRKVTEKDIIHYLHTVDGYDGIELKGIEKQFNASLSTYHDLLKIIK<br>DKEFMDDPKNEEILENIIHTLTIFEDREMIKQRLAQYDSIFDEKVIKALTRRHYTGWGKLSAKLINGI<br>YDKQSKKTILDYLIDDDKINRNFMQLINDDGLSFKEIIQKAQVVGKTDDVKQVVQELPGSPAIKKGI<br>LQSIKIVDELVKVMGGDPESIVVEMARENQFTNQGRRNSQQRYKKIKEAIKNLDSDLNSKILKEYPT<br>DNQALQNDRLFLYYLQNGKDMYTGEALDINQLSNYDIDHIIPQAFIKDDSLDNRVLTSSKDNRGKS<br>DNVPSLEIVEKMKGFWRQLLDSKLISQRKFDNLTKAERGGLTEHDKAGFIKRQLVETRQITKHVAQ<br>ILDARFNTEVNDKKQKIRNVKIITLKSNLVSNFRKEFGLYKVREINDYHHAHDAYLNAVVAKAILK<br>KYPKLEPEFVYGDYQKYDIKRYISRSKDPKEIEKATEKYFFYSNLLNFFKEEVHYADGTIIKRENIEY<br>SKDTGEIAWNKEKDFATVRKVLSCPQVNIVKKTEVQTGGFSKESILPKRNSDKLIARKKDWDPKK<br>YGGFDSPTVAYSVLVVAKVEKGKSKKLKSVKELLGITIMERSSFEKNPIDFLEAKGYKEVRKDLIV<br>KLPKYSLFELENGRKRMLASAGELQKGNELALPSKYVNFLYLASHYEKLKGSPEDNEQKQLFVEQ<br>HKHYLDEIIEQISEFSKRVILADANLDKVLSAYNKHRDKPIREQAENIIHLFTLTNLGAPAAFKYFDT<br>TIDRKRYTSTKEVLDATFIHQSITGLYETRIDLSQLGGD |
| 127 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKAYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKKDRILKLFPGEKNSGIFSEFLKLIVGNQADFKKYFNLDEKAPLHES<br>KESYDEDLETLLGHIGDDYSDVFLKAKKLYDAILLSGILTVTDNETEAPLSSAMIRYKEHEEDLAL<br>LKAYIRNISLETYNEVFKDDTKNGYAGYIDGKTNQEDFYVYLKKLLTGLEGADYFLEKINREDLLR<br>KQRTFDNGSIPHQIHLQEMHAILRKQEKFYPPLAKNKERIEKILTFRIPYYVGPLARGNSDFAWSIRK<br>RNEKITPWNFEDVIDKESSAEAFINRMTSFDLYLPEEKVLPKHSLLYETFTVYNELTKVRFIAESMR<br>DYQFLDSKQKKDIVRLYFKGKRKVTDKDIIDYLHAIDGYDGIELKGIEKQFNSSLSTYHDLLNIIND<br>KEFLDDSSNEAIIEEIIHTLTIFEDREMIKQRLSKFENIFDKSVLKKLSRRHYTGWGKLSAKLINGIRD<br>EKSGKTILDYLIDDGVSNRNFMQLIHDDTLSFKKKIQKAQIIGDQDNIKQVVQSLPGSPAIKKGILQSI<br>KIVDELVKVMGRNPESIVVEMARENQYTNQGKSNSQQRLKRLEESLKELGSKILKENVPAKLSKID<br>NNALQNERLYLYYLQNGKDMYTGDDLDIDRLSNYDIDHIIPQAFLKDNSIDNKVLVSSASNRGKSD<br>DVPSLDVVKRKTFWHQLLKSKLISQRKFDNLTKAERGGLTPEDKAGFIQRQLVETRQITKHVAQL<br>LDNRFNEKRDEKKVIRKVNIVLLKSSLVSQFRKDFELYKVREINDFHHAHDAYLNAVVATALLK<br>KYPKLEPEFVYGEYSKFKVSKDIDKATEKYFFYSNLLNFFKEKVLYADGTVVFRKNVEYSKDTGEI<br>AWNKEKDFATVRKVLSCPQVNIVKKTEVQTGGFSKESILPKRNSDKLIARKKDWDPKKYGGFDSP<br>TVAYSVLVVAKVEKGKSKKLKSVKELLGITIMERSSFEKNPIDFLEAKGYKEVRKDLIVKLPKYSLF<br>ELENGRKRMLASAGELQKGNELALPSKYVNFLYLASHYEKLKGSPEDNEQKQLFVEQHKHYLDEI<br>IEQISEFSKRVILADANLDKVLSAYNKHRDKPIREQAENIIHLFTLTNLGAPAAFKYFDTTIDRKRYT<br>STKEVLDATFIHQSITGLYETRIDLSQLGGD |
| 128 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQEFLDSYNAIFESDL<br>SLENSKQLEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQLAAL<br>KQFIQNNIQEKYDEVFSDQSKDGYAGYINGKTTQEAFYKYIKNLLSKLEGADYFLDKIEREDFLRK<br>QRTFDNGSIPHQIHLQEMNAIIRRQGEHYPFLQENKEKIEKILTFRIPYYVGPLARGNRDFAWLTRNS<br>DQAIRPWNFEEVVDQASSAEEFINKMTNYDLYLPEEKVLPKHSLLYETFAVYNELTKVKFIAEGLR<br>DYQFLDSGQKKQIVNQLFKEKRKVTEKDIIHYLHNVDGYDGIELKGIEKQFNASLSTYHDLLKIIKD<br>KEFMDDPKNEEILENIIHTLTIFEDREMIKQRLAQYDSIFDEKVIKALTRRHYTGWGKLSAKLINGIY<br>DKQSKKTILDYLIDDDKINRNFMQLINDDGLSFKEIIQKAQVVGKTDDVKQVVQELPGSPAIKKGIL<br>QSIKLVDELVKVMGHAPESIVIEMARENQTTARGKKNSQQRYKRIEDALKNLAPGLDSNILKEHPT<br>DNIQLQNDRLFLYYLQNGKDMYTGNPLDINQLSSYDIDHIVPQAFIKDDSLDNRVLTSSKDNRGKS<br>DNVPSLEVVQKRKAFWQQLLDSKLISEHKFNNLTKAERGGLTRQDKVGFIKRQLVETRQITKHVA<br>QILDARFNTEVNENNQKIRKVKIITLKSNLVSNFRKEFGLYKVREINDYHHAHDAYLNAVVAKAIL<br>KKYPKLEPEFVYGDYQKYDIKRYISRSKDPKEIEKATEKYFFYSNLLNFFKEEVHYADGTIVKRENI<br>EYSNDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 129 | MNKPYSIGLDIGTNSVGWAVITDDYKVPSKKMKVLGNTDKKYIKKNLLGALLFEGGETAEGRRLK<br>RTARRRYTRRRNRILYLQEIFAAEMNKVDESFFHRLDDSFLVPEDKRGSKYPIFGTLEEEKEYHKKF<br>PTIYHLRKHLADSKEKADLRLIYLALAHMIKYRGHFLYEDSFDIKNNDIQKIFNEFTSIYDNTFEESS<br>LSKGNAQVEEIFTDKISKSAKRERVLKLFPDEKSTGLFSEFLKLIVGNQADFKKHFDLEEKAPLQFS<br>KDTYDEDLENLLGQIGDMYADLFLVAKKLYDAILLSGILTVTDPTTKAPLSASMIERYENHQEDLA<br>ALKQFIKNNLSEKYAEVFSDASKDGYAGYIEGKTTQENFYKFIKKAIEKIEGSDYFIDKIEREDFLRK<br>QRTFDNGSIPHQIHLQEMHAIIRRQAEFYPPLAENQDKIEKILTFRIPYYVGPLARGKSEFAWLNRKS |

| SEQ ID NO | Nuclease Sequence |
|---|---|
| | DEKIRPWNFDEMVDKETSAENFITRMTNYDQYLPDQKVLPKHSLLYEKFAVYNELTKVRYVTEQG<br>KSFFFDANMKQEIFDKTFKVYRKVTKEKLMDFLGKEFDEFRIVDLMGLDKDNKSFNASLGTYHDL<br>KKIVSKDFLDNPENEDILENVVLTLTLFEDREMIRKRLEKYKDVLTEEQRKKLERRHYTGWGRLSA<br>KLINGIRDKVTRKTILDYLIDDGTSNRNFMQLIHDDTLSFVDEIRLAQSSGEAEDYRAEVQNLAGSP<br>AIKKGILQSLKIVDELIEVMGYDPEHIVVEMARENQFTNQGRRNSQQRYKKIKDAIKNLDSNLNSKI<br>LKEYPTNNQALQNDRLFLYYLQNGKDMYTGEALDINQLSNYDIDHIIPQAFIKDDSLDNRVLTSSK<br>DNRGKSDNVPSIEVVEKMKAFWQQLLDSKLISERKYNNLTKAERERGGLNELDKVGFIKRQLVET<br>RQITKHVAQILDAKFNTEKDENGKRIRKVKIITLKSNLVSNFRKEFGLYKVREINDYHHAHDAYLN<br>AVVAKAILKKYPKLEPEFVYGDYQKYDIKRYISRSKDPKEIEKATEKYFFYSNLLNFFKEEVHYAD<br>GTIIKRENIEYSKDTGEIAWNKEKDFATVRKVLSCPQVNIVKKTEVQTGGFSKESILPKRNSDKLIAR<br>KKDWDPKKYGGFDSPTVAYSVLVVAKVEKGKSKKLKSVKELLGITIMERSSFEKNPIDFLEAKGY<br>KEVRKDLIVKLPKYSLFELENGRKRMLASAGELQKGNELALPSKYVNFLYLASHYEKLKGSPEDN<br>EQKQLFVEQHKHYLDEIIEQISEFSKRVILADANLDKVLSAYNKHRDKPIREQAENIIHLFTLTNLGA<br>PAAFKYFDTTIDRKRYTSTKEVLDATFIHQSITGLYETRIDLSQLGGD |
| 130 | MKKSYSIGLDIGTNSVGWAVVDDDYKVPAKKMRVFGDTDRSHIKKNLLGTLLLFDSGETAESRRLK<br>RTARRRYTRRRNRILYLQEIFAEEMNKVDDSFFHRLDESFLTDDDKTFDSHPIFGNKAEEDAYHQK<br>FPTIYHLRKHLADSTEKADLRLVYLALAHMIKFRGHFLIEGELNAENTDVQKLFAQFVGVYDRTFD<br>DSHLSEITVDASSILTEKISKSRRLENLIKHYPTEKKNTLFGNLVALALGLQPNFKTNFKLSEDAKLQ<br>FSKDTYEEDLEELLGKIGDEYADLFTSAKNLYDAILLSGILTVDDTSTKAPLSASMIKRYAEHHEDL<br>EKLKEFIKANKPELYHDIFKDETKNGYAGYIENGVKQDEFYKYLKTTLSKIDGSQYFLDKIEREDFL<br>RKQRTFDNGSIPHQIHLQEMHAILRRQGEYYPFLKENQAKIEKILTFRIPYYVGPLARKDSRFAWAN<br>YHSDEPITPWNFDEVVDKEKSAEKFITRMTLNDLYLPEEKVLPKHSVYETFTVYNELTKIKYVNE<br>QGESFFFDANMKQEIFDHVFKENRKVTKDKLLDFLNKEFEEFRIVDLIGLDKENKSFNASLGTYHD<br>LKKILDKSFLDDKTNEQIIEDIVLTLTLFEDRDMIRQRLQKYSDIFTPQQLKKLERRHYTGWGRLSY<br>KLINGIRNKENNKTILDFLIDDGHANRNFMQLINDESLSFKTIIQEAQVVGDVDDIEAVVHDLPGSPA<br>IKKGILQSVKIVDELVKVMGDNPDNIVIEMARENQTTNRGRTQSQQRLKKLQESLKELGSNILNEE<br>KPSYIEDKVENSHLQNDKLFLYYIQNGKDMYTGDELDIDHLSDYDIDHIIPQAFIKDDSIDNRVLTSS<br>AKNRGKSDDVPSLDIVHDRKADWIRLYKSGLISKRKFDNLTKAERGGLTEADKAGFIKRQLVETR<br>QITKHVAQILDARFNTKRDENDKVIRDVKIITLKSNLVSQFRKEFGFYKVREINDYHHAHDAYLNA<br>VVGTALLKKYPKLAPEFVYGEYIKYDIKGDITKSKIETTRDKATAKYFFYSNLLNFFKTKVRYADG<br>TVIVRPVIEYSKDTGEIAWNKEKDFATVRKVLSCPQVNIVKKTEVQTGGFSKESILPKRNSDKLIAR<br>KKDWDPKKYGGFDSPTVAYSVLVVAKVEKGKSKKLKSVKELLGITIMERSSFEKNPIDFLEAKGY<br>KEVRKDLIVKLPKYSLFELENGRKRMLASAGELQKGNELALPSKYVNFLYLASHYEKLKGSPEDN<br>EQKQLFVEQHKHYLDEIIEQISEFSKRVILADANLDKVLSAYNKHRDKPIREQAENIIHLFTLTNLGA<br>PAAFKYFDTTIDRKRYTSTKEVLDATFIHQSITGLYETRIDLSQLGGD |
| 131 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQDFLDSYNAIFESDL<br>SLENSKQLEEIVKDKISKSAKKDRLLKLFPGEKNSGIFSEFLKLIVGNQADFRKYFNLDEKASLHFSK<br>ESYDEDLETLLGHIGDDYSDVFLKAKKLYDAILLSGILTVTDNETEAPLSSAMIMRYKEHEEDLALL<br>KAYIRKISLETYNEVFKDDTKNGYAGYIDGKTNQEDFYVYLKKLLTGLEGADYFLEKINREDLLRK<br>QRTFDNGSIPYQIHLQEMRAIIDKQAKFYPPLAKNKERIEKILTFRIPYYVGPLARGNSDFAWSIRKR<br>NEKITPWNFEDVIDKESSAEAFINRMTSFDLYLPEEKVLPKHSLLYETFTVYNELTKVRFIAESMRD<br>YQFLDSKQKKDIVRLYFKGKRKVTDKDIIDYLHAIDGYDGIELKGIEKQFNSSLSTYHDLLNIINDKE<br>FLDDSSNEAIIEEIIHLTIFEDREMIKQRLSKFENIFDKSVLKKLSRRHYTGWGKLSAKLINGIRDKEK<br>SGKTILDYLIDDGVSNRNFMQLIHDDTLSFKKKIQKAQIIGDQDNIKQVVQSLPGSPAIKKGILQSIKI<br>VDELVKVMGREPESIVVEMARENQYTNQGKSNSQQRLKRLEESLKELGSKILKENVPAKLSKIDNN<br>ALQNERLYLYYLQNGKDMYTGDDLDIDRLSNYDIDHIIPQAFLKDNSILDNKVLVSSASNRGKSDDV<br>PSIEVVKARKTFWHQLLKSQLISQRKFDNLTKAERGGLTDDDKAGFIRRQLVETRQITKHVAQLLD<br>SRFNTKRDDNDKVIRNVKIITLKSSLVSQFRKEFGLYKVREINDYHHAHDAYLNAVVATAILKKYP<br>KLEPEFVYGDYQKYDVRKYLSTKDNKDLGKATAKMFFYSNLMNFFKKEVRLADGTVVVRPVIEY<br>SKDTGEIAWNKEKDFATVRKVLSCPQVNIVKKTEVQTGGFSKESILPKRNSDKLIARKKDWDPKKY<br>YGGFDSPTVAYSVLVVAKVEKGKSKKLKSVKELLGITIMERSSFEKNPIDFLEAKGYKEVRKDLIV<br>KLPKYSLFELENGRKRMLASAGELQKGNELALPSKYVNFLYLASHYEKLKGSPEDNEQKQLFVEQ<br>HKHYLDEIIEQISEFSKRVILADANLDKVLSAYNKHRDKPIREQAENIIHLFTLTNLGAPAAFKYFDT<br>TIDRKRYTSTKEVLDATFIHQSITGLYETRIDLSQLGGD |
| 132 | MKKYSIGLDIGTNSVGWAVVDDDYKVPAKKMRVFGDTDRSHIKKNLLGTLLLFDSGETAESRRLKR<br>TARRRYTRRRNRILYLQEIFAEEMNKVDDSFFHRLDESFLTDDDKNFDSHPIFGNKAEEDAYHQKF<br>PTIYHLRKHLADSTEKADLRLVYLALAHMIKFRGHFLIEGELNAENTDVQKLFEQFVGVYDRTFDD<br>SHLSEITVDASSILTEKISKSRRLENLIKHYPTEKKNTLFGNLVALALGLQPNFKTNFKLSEDAKLQF<br>SKDTYEEDLEELLGKIGDEYADLFTSAKNLYDAILLSGILTVDDNSTKAPLSASMIKRYEEHHEDLE<br>KLKTFIRVNNSDKYHEIFNDKDKNGYAGYIENGVKQDEFYKYLKETLSKIAGSQYFLDKIEREDFL<br>RKQRTFDNGSIPHQIHLQEMHAILRRQGEYYPFLKENQAKIEKILTFRIPYYVGPLARKDSRFAWAN<br>YHSDEPITPWNFDEVVDKEKSAEKFITRMTINDLYLPEEKVLPKHSVYETYAVYNELTKIKYVNE<br>QGESFFDANMKQEIFEHVFKENRKVTKDKFLNYLNKEFPEYRIQDLLGLDKENKSFNASLGTYHD<br>LKKILDKSFLDDKTNEQIIEDIIQTLTLFEDRDMIRQRLQKYSDIFTKQQLKKLERRHYTGWGRLSY<br>KLINGIRNKENNKTILDYLIDDGYANRNFMQLINDDTLPFKQIIQKSQVVGDIDDIKAVVHDLPGSP<br>AIKKGILQSVKIVDELVKVMGHNPDNIVIEMARENQTTNRGRSQSQQRLKKLQESLKELGSNILNEE<br>KPSYIEDKVENSHLQNDKLFLYYIQNGKDMYTGDELDIDHLSDYDIDHIIPQAFIKDDSIDNRVLTSS<br>AKNRGKSDDVPSLDIVHDRKADWIRLYKSGLISKRKFDNLTKAERGGLTEADKAGFIKRQLVETR<br>QITKHVAQILDARFNTKRDDNDKVIRDVKVITLKSNLVSQFRKEFGFYKVREINDYHHAHDAYLN |

| SEQ ID NO | Nuclease Sequence |
|---|---|
|  | AVVGTALLKKYPKLAPEFVYGEYKKYDIRKFITATDDKATAKYFFYSNLLNFFKTKVRYADGTVI<br>VRPVIEYSKDTGEIAWNKEKDFATVRKVLSCPQVNIVKKTEVQTGGFSKESILPKRNSDKLIARKKD<br>WDPKKYGGFDSPTVAYSVLVVAKVEGKSKKLKSVKELLGITIMERSSFEKNPIDFLEAKGYKEVR<br>KDLIVKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDATFIHQSITGLYETRIDLSQLGGD |
| 133 | MTKPYSIGLDIGTNSVGWAVITDSYKVPSKKMKVLGNTSKKYVKKNLLGALLFESGITAEGRRLK<br>RTARRRYTRRRNRILYLQEIFSTEMSKIDESFFQRLDDSFLVPDDKRDSKYPIFGNLVEEKTYHDEFP<br>TIYHLRKYLADSSKKADLRLVYLALAHMIKYRGHFLIEGDENSKNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDGFADLFLVAKKLYDAILLSGILTVTDPSTKAPLSASMIERYENHQKDLA<br>ALKQFIKNNLPEKYDEVFSDQSKDGYAGYIDGKTTQEAFYKYIKNLLSKFEGADYFLDKIEREDFL<br>RKQRTFDNGSIPHQIHLQEMNAIIRRQGEHYPFLKENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEGL<br>RDYQFLDSGQKKQIVNQLFKEKRKVTEKDIIQFLHNVDGYDGIELKGIEKQFNASLSTYHDLLKIIK<br>DKEFMDDPKNEEILENIVHTLTIFEDREMIKQRLAQYDSLFDEKVIKALTRRHYTGWGKLSAKLING<br>IRDKQSQKTILDYLIDDGEINRNFMQLIHDDGLSFKEIIQKAQVFGKTDDVKQVVQELPGSPAIKKGI<br>LQSIKIVDELVKVMGHNPEHIVVEMARENQFTNQGRRNSQQRYKKIMEAIKNLDSNLNSKILKEYP<br>TDNQALQNDRLFLYYLQNGKDMYTGEALDINQLSNYDIDHIIPQAFIKDDSLDNRVLTSSKDNRGK<br>SDNVPSLEIVEKMKGFWQQLLNSKLISERKFNNLTKAERGGLDERDKVGFIKRQLVETRQITKHVA<br>QILDARFNTEVNEKNQKIRTVKIITLKSNLVSNFRKEFGLYKVREINDYHHAHDAYLNAVVAKAIL<br>KKYPKLEPEFVYGDYQKYEISRYISRSKISDSIDKATAKYFFYSNLLNFFKEKVRYSNGTVIIRPVIEY<br>SKDTGEIAWNKEKDFATVRKVLSCPQVNIVKKTEVQTGGFSKESILPKRNSDKLIARKKDWDPKK<br>YGGFDSPTVAYSVLVVAKVEGKSKKLKSVKELLGITIMERSSFEKNPIDFLEAKGYKEVRKDLIV<br>KLPKYSLFELENGRKRMLASAGELQKGNELALPSKYVNFLYLASHYEKLKGSPEDNEQKQLFVEQ<br>HKHYLDEIIEQISEFSKRVILADANLDKVLSAYNKHRDKPIREQAENIIHLFTLTNLGAPAAFKYFDT<br>TIDRKRYTSTKEVLDATFIHQSITGLYETRIDLSQLGGD |
| 134 | MTKPYSIGLDIGTNSVGWAVITDNYKVPSKKMKVLGNTSKKYVKKNLLGALLFESGITAEGRRLK<br>RTARRRYTRRRNRILYLQEIFSTEMAEIDESFFQRLDDSFLVPDDKRDSKYPIFGNLVKEKTYHDEFP<br>TIYHLRKYLADSSKKADLRLVYLALAHMIKYRGHFLIEGDFNSRNNDIKKNFQEFLDSYNAIFESDL<br>SLENSKQLEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLAAL<br>KQFIQNNLPEKYDEVFSDQSKDGYAGYIDGKTTQEAFYKYIKNLLSKFEGADYFLEKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDQKASSAEDFINKMTNYDLYLPEEKVLPKHSLLYETFAVYNELTKVKFIAEGLD<br>RYQFLDKKQKKDIFDTFFKAEDKRKVTEKDIIHYLHNVDGYDGIELKGIEKQFNASLSTYHDLLKII<br>KDKEFMDDPKNEEILENIVHTLTIFEDREMIKQRLAQYDSLFDEKVIKALTRRHYTGWGKLSAKLIN<br>GIYDKQSKKTILDYLIDDDKINRNFMQLINDDGLSFKDIIQKAQVVGKTDDVKQVVQELPGSPAIKK<br>GILQSIKIVDELVKVMGHAPESIVIEMARENQTTARGKKNSQQRYKRIEDALKNLAPGLDSNILKEN<br>PTDNVQLQNDRLFLYYLQNGKDMYTGEALDINQLSNYDIDHIIPQAFIKDDSLDNRVLTSSNDNRG<br>KSDNVPSIEVVQKRKAFWQQLLDSKLISERKENNLTKAERGGLDERDKVGFIKRQLVETRQITKHV<br>AQILDARFNTEVDENNKKIRKVKIITLKSNLVSNFRKEFELYKVREINDYHHAHDAYLNAVVAKAI<br>LKKYPKLEPEFVYGDYQKYDIKRYISKSKDPKEIDKATEKYFFYSNLLNFFKEEVHYADGTIIKRENI<br>EYSKDTGEIAWNKEKDFATVRKVLSCPQVNIVKKTEVQTGGFSKESILPKRNSDKLIARKKDWDPK<br>KYGGFDSPTVAYSVLVVAKVEGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 135 | MKKPYSIGLDIGTNSVGWAVVTDDYKVPAKKMKVLGDTDKSHIKKNLLGTLLFESGETAEGRRLK<br>RTARRRYTRRRNRILYLQEIFAEEMNKVDDSFFQRLDESFLKDDDKNFDSHPIFGNKAEEDAYHQK<br>FPTIYHLRQYLADSPEKADLRLVYLALAHIIKYRGHELFEGDLKSENKDVQHLFNDPFVEMEDKTVE<br>GSYLSENLPNVADVLVEKVSKSRRLENVLHYFPNEKKNGLFGNFIALALGLQPNFKTNFKLSEDAK<br>LQFSKDTYDEDLEELLGKIGDDYADLFVAAKNLYDAILLSGILTVTDPTTKAPLSASMIDRYEKHH<br>KDLALLKNLIKQNLTQEKYDEVFSDESKNGYAGYISGKVKQEEFYKYLKNTLSKIEGSDYFLDKIE<br>REDFLRKQRTFDNGSIPHQIHLQEMNAIIRRQGEHYPFLKENKEKIEKILTFRIPYYVGPLARGNRDF<br>AWLTRNSDQAIRPWNFEEIVDQASSAEDFINKMTNYDLYLPEEKVLPKHSLLYETFAVYNELTKVK<br>FIAEGLRDYQFLDSGQKKQIVNQLFKEKRKVTEKDIIQYLHNVDGYDGIELKGIEKQFNASLSTYHD<br>LLKIIKDKEFMDDPKNEEILENIVHTLTIFEDREMIKQRLAQYDSLFDEKVIKALTRRHYTGWGKLS<br>AKLINGIYDKQSKKTILDYLIDDGEINRNFMQLINDDGLSFKDIIQKAQVVGKTNDVKQVVQELPGS<br>PAIKKGILQSIKLVDELVKVMGHAPESIVIEMARENQTTARGKKNSQQRYKRIEDALKNLAPGLDS<br>NILKENPTDNIQLQNDRLFLYYLQNGKDMYTGEALDINQLSNYDIDHIVPQAFIKDDSLDNRVLTSS<br>KDNRGKSDNVPSIEVVQKRKAFWQQLLDSKLISERKENNLTKAERGGLDERDKVGFIKRQLVETR<br>QITKHVAQILDARFNTEVDENNQRIRKVKIITLKSNLVSNFRKEFGLYKVREINDYHHAHDAYLNA<br>VVAKAILKKYPKLEPEFVYGDYQKYDLKRYISRSKDPKDIEKATEKYFFYSNLLNFFKEEVHYADG<br>TIIKRENIEYSNDTGEIAWNKEKDFATVRKVLSCPQVNIVKKTEVQTGGFSKESILPKRNSDKLIARK<br>KDWDPKKYGGFDSPTVAYSVLVVAKVEGKSKKLKSVKELLGITIMERSSFEKNPIDFLEAKGYKE<br>VRKDLIVKLPKYSLFELENGRKRMLASAGELQKGNELALPSKYVNFLYLASHYEKLKGSPEDNEQ<br>KQLFVEQHKHYLDEIIEQISEFSKRVILADANLDKVLSAYNKHRDKPIREQAENIIHLFTLTNLGAPA<br>AFKYFDTTIDRKRYTSTKEVLDATFIHQSITGLYETRIDLSQLGGD |

| SEQ ID NO | Nuclease Sequence |
|---|---|
| 136 | MKKPYSIGLDIGTNSVGWAVITDDYKVPAKKMKVLGNTDKSHIKKNLIGALLFDSGNTAEDRRLK<br>RTARRRYTRRRNRILYLQEIFAEEMNKVDESFFHRLDDSFLVPEDKRGSKYPIFATLEEEKEYHKKF<br>PTIYHLRKHLADSKEKTDLRLIYLALAHMIKYRGHFLYEESFDIKNNDIQKIFNEFISIYDNTFEGSSL<br>SGQNAQVEAIFTDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQEDLAAL<br>KQFIRNNLQEKYDEVFSDSSKDGYAGYIEGKTNQEAFYKYMKKLLTKVEGADYFLEKIKDENFLR<br>KQRTFDNGSIPHQVHLREMHAIIRRQGEYYPFLKENREKIEKILTFRIPYYVGPLARGKSDFAWMTR<br>KSDDAIRPWNFEEMVDKEASAMAFIHRMTNNDFYLPEEKVLPKHSLLYEKFAVYNELTKVRYVTE<br>QGKSFFFDANMKQEIFDKTFKVYRKVTKEKLMDFLGKEFDEFRIVDLMGLDKENKSFNASLGTYH<br>DLKKIVSKDFLDNPENEDILENVVLTLTLFEDREMIRKRLEKYKDVLTEEQRKKLERRHYTGWGRL<br>SAKLINGIRDKVTRKTILDYLIDDGTSNRNFMQLIHDDTLSFVDEIRLAQSSGEAEDYRAEVQNLAG<br>SPAIKKGILQSLKIVDELIEVMGYDPEHIVVEMARENQFTNQGRRNSQQRYKKIKEAIKNLDSNLNS<br>KILKEYPTNNQALQNDRLFLYYLQNGKDMYTGEALDINQLSSYDIDHIVPQAFIKDDSLDNRVLTS<br>SKDNRGKSDNVPSLEVVQKRKAFWQQLLDSKLISERKENNLTKAERGGLDERDKVGFIKRQLVET<br>RQITKHVAQILDARFNTEVNEKGKRIRKVKIITLKSNLVSNFRKEFGLYKVREINDYHHAHDAYLN<br>AVVAKAILKKYPKLEPEFVYGDYQKYDIKRYISRSKDPKEIEKATQKYFFYSNLLNFFKEEVHYAD<br>GTIIKRENIEYSKDTGEIAWNKEKDFATVRKVLSCPQVNIVKKLTEVQTGGFSKESILPKRNSDKLIAR<br>KKDWDPKKYGGFDSPTVAYSVLVVAKVEKGKSKKLKSVKELLGITIMERSSFEKNPIDFLEAKGY<br>KEVRKDLIVKLPKYSLFELENGRKRMLASAGELQKGNELALPSKYVNFLYLASHYEKLKGSPEDN<br>EQKQLFVEQHKHYLDEIIEQISEFSKRVILADANLDKVLSAYNKHRDKPIREQAENIIHLFTLTNLGA<br>PAAFKYFDTTIDRKRYTSTKEVLDATFIHQSITGLYETRIDLSQLGGD |
| 137 | MNKPYSIGLDIGTNSVGWAVITDSYKVPSKKMKVLGNTSKKYVKKNLLGALLFESGITAEGRRLK<br>RTARRRYTRRRNRILYLQEIFSTEMKKIDESFFQRLDDSFLVPEDKRGSKYPIFGNLAQEKTYHEKFP<br>TIYHLRKYLADSSKKADLRLVYLALAHMIKYRGHFLIEGDFNSRNNDIKKNFQNFLDSYNAIFESDL<br>SLENSKQLEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLAAL<br>KQFIQNNLQEKYDEVFSDQSKDGYAGYIDGKTTQEAFYKYIKNLLSKFEGADYFLEKIEREDFLRK<br>QRTFDNGSIPHQIHLQEMNAILRRQGEYYPFLKENKEKIELTFRIPYYVGPLARGNRDFAWLTRN<br>SDQAIRPWNFEEVVDQASSAEEFINKMTNYDLYLPEEKVLPKHSLLYETFAVYNELTKVKFIAEGL<br>RDYQFLDSGQKKQIVNQLFKEKRKVTEKDIIQFLHNVDGYDGIELKGIEKQFNASLSTYHDLLKIIK<br>DKEFMDDPKNEEILENIVHTLTIFEDREMIKQRLAQYDSLFDEKVIKALTRRHYTGWGKLSAKLING<br>IRDKQSGKTILDFLIDDDKINRNFMQLINDDGLSFKEIIQKAQVVKTDDIKQVVQNLPGSPAIKKGI<br>LQSIKIVDELVKVMGRDPESIVVEMARENQFTNQGRRNSQQRYKKIENAIKNLDKNLNSKILKEYP<br>TNNQALQNDRLFLYYLQNGKDMYKDEELDINQLSNYDIDHIVPQAFIKDDSLDNRVLTSSKDNRG<br>KSDNVPSIEVVQKRKGFWQQLLDSKLISERKENNLTKAERGGLDERDKVGFIKRQLVETRQITKHV<br>AQILDARFNTEVNENNQKIREVKIITLKSNLVSNFRKEFGLYKVREINDYHHAHDAYLNAVVAKAI<br>LKKYPKLEPEFVYGDYQKYDIKRYISRSKDPKDIEKATEKYFFYSNLLNFFKEEVTYADGTIKKREN<br>IEYSNDTGEIAWNKEKDFATVRKVLSCPQVNIVKKTEVQTGGFSKESILPKRNSDKLIARKKDWDP<br>KKYGGFDSPTVAYSVLVVAKVEKGKSKKLKSVKELLGITIMERSSFEKNPIDFLEAKGYKEVRKDL<br>IVKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 138 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKAYHDEF<br>PTIYHLRKYLADSSKKADLRLVYLALAHMIKYRGHFLIEGDFNSRNNDIKKNFQDFLDSYNAIFESDL<br>SLENSKQLEEIVKDKISKSAKKDRLLKLFPGEKNSGIFSEFLKLIVGNQADFRKYFNLEDQASLQFS<br>KESYDEDLETLLGHIGDDYSDVFLKAKKLYDAILLSGILTVTDNETEAPLSSAMIMRYKEHEEDLAL<br>LKAYIRNISLETYNEVFKDDTKNGYAGYIDGKTNQEDFYVYLKKLLTGLEGADYFLEKINREDLLR<br>KQRTFDNGSIPYQIHLQEMRAIIDKQAKFYPFLAKNKERIEKILTFRIPYYVGPLARGNSDFAWSIRK<br>RNEKITPWNFEDVIDKESSAEAFINRMTSFDLYLPEEKVLPKHSLLYETFTVYNELTKVRFIAESMR<br>DYQFLDSKQKKDIVRLYFKGKRKVTDKDIIDYLHAIDGYDGIELKGIEKQFNSSLSTYHDLLNIIND<br>KEFLDDSSNEAIIEEIIHTLTIFEDREMIKQRLSKFENIFDKSVLKKLSRRHYTGWGRLSAKLINGIRD<br>EKSGKTILDYLIDDGVSNRNFMQLIHDDTLSFKKKIQKAQIIGDQDNIKQVVQSLPGSPAIKKGILQSI<br>KIVDELVKVMGRNPESIVVEMARENQYTNQGKSNSQQRLKRLEESLKDLGSKILKENVPAKLSKID<br>NNALQNERLYLYYLQNGKDMYTGEELDIDRLSNYDIDHIIPQAFLKDNSIDNKVLVSSASNRGKSD<br>DVPSLDVVKKRKTFWHQLLKSQLISQRKFDNLTKAERGGLTEADKAGFIQRQLVETRQITKHVAR<br>LLDDARFNTKRDDNDKVIRDVKVITLKSSLVSQFRKDFELYKVREINDFHHAHDAYLNAVVATALL<br>KKYPKLEPEFVYGDYPRYNSFRERKSATERMLFYSNIMNFFKRVKVHLDSNGKVVVRPVIEYSKD<br>TGEIAWNKEKDFATVRKVLSCPQVNIVKKTEVQTGGFSKESILPKRNSDKLIARKKDWDPKKYGG<br>FDSPTVAYSVLVVAKVEKGKSKKLKSVKELLGITIMERSSFEKNPIDFLEAKGYKEVRKDLIVKLPK<br>YSLFELENGRKRMLASAGELQKGNELALPSKYVNFLYLASHYEKLKGSPEDNEQKQLFVEQHKHY<br>LDEIIEQISEFSKRVILADANLDKVLSAYNKHRDKPIREQAENIIHLFTLTNLGAPAAFKYFDTTIDRK<br>RYTSTKEVLDATFIHQSITGLYETRIDLSQLGGD |
| 139 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFSNFLDSYNAIFESDL<br>SLENSKQLEEIVKDKISKSAKRERVLKLFPDEKSTGLFSEFLKLIVGNQAEFKKHFDLEEKAPLQFSK<br>DTYDEDLENLLGQIGDDFADLFLVAKKLYDAILLSGILTVTDPATKAPLSASMIERYENHQKDLSAL<br>KQFIKRNLSEKYDEVFSDQSKDGYAGYINGKTTQEAFYKYIKNLLSKLEGADYFLDKIEREDFLRK<br>QRTFDNGSIPHQIHLQEMNAILRRQGEHYPFLKENKEKIQQILTFRIPYYVGPLARGNRDFAWLTRN<br>SDQAIRPWNFEEIVDKASSAEDFINKMTNYDLYLPEEKVLPKHSLLYETFAVYNELTKVKFIAEGLR |

| SEQ ID NO | Nuclease Sequence |
|---|---|
|  | DYQFLDSGQKKQIVNQLFKEKRKVTEKDIIHYLHNVDGYDGIELKGIEKQFNASLSTYHDLLKIIKD<br>KEFMDDPKNEEILENIVHTLTIFEDREMIKQRLAQYDSIFDEKVIKALTRRHYTGWGKLSAKLINGI<br>YDKQSKKTILDYLIDDDKINRNFMQLINDDSLSFKDIIQKAQVVGKTDDVKQVVQELPGSPAIKKGI<br>LQSIKIVDELVKVMGHAPESIVIEMARENQTTARGKKNSQQRYKRIEDALKNLAPGLDSNILKENPT<br>DNVQLQNDRLFLYYLQNGKDMYTGEALDINQLSNYDIDHIVPQAFIKDDSLDNRVLTSSKDNRGK<br>SDNVPSLEVVQKRKAFWQQLLDSKLISQRKFDNLTKAERGGLTEHDKAGFIKRQLVETRQITKHV<br>AQILDARFNTEVNEKNQKIRKVKIITLKSNLVSNFRKEFRLYKVREINDYHHAHDAYLNAVVAKAI<br>LKKYPKLEPEFVYGDYQKYDIKRYISRTKDPKAIEKATQKYFFYSNLLNFFKEEVHYADGTIIKREN<br>IEYSKDTGEIAWNKEKDFATVRKVLSCPQVNIVKKTEVQTGGFSKESILPKRNSDKLIARKKDWDP<br>KKYGGFDSPTVAYSVLVVAKVEKGKSKKLKSVKELLGITIMERSSFEKNPIDFLEAKGYKEVRKDL<br>IVKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 140 | MTKPYSIGLDIGTNSVGWAVISDSYKVPSKKMKVLGNTSKKYVKKNLLGALLFESGITAEGRRLKR<br>TARRRYTRRRNRILYLQEIFATEMSKIDESFFQRLDDSFLVPDDKRDSKYPIFGNLVKEKTYHDEFPT<br>IYHLRKYLADSSKKADLRLVYLALAHMIKYRGHFLIEGDFNSRNNDIKKNFQNFLDSYNAIFESDLS<br>LENSKQLEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLATL<br>KQFIKTNLPEKYDEVFSDQKSDGYAGYIDKTTQEAFYKYIKNLLSKLEGADYFLDKIEREDFLRK<br>QRTFDNGSIPHQIHLQEMNAILRRQGEHYPFLKENKEKIEKILTFRIPYYVGPLARGNRDFAWLTRN<br>SDQAIRPWNFEEIVDKASSAEDFINKMTNYDLYLPEEKVLPKHSLLYETFAVYNELTKVKFIAEGLR<br>DYQFLDSGQKKQIVNQLFKEKRKVTEKDIIHYLHNVDGYDGIELKGIEKQFNASLSTYHDLLKIIKD<br>KEFMDDPKNEEILENIVHTLTIFEDREMIKQRLAQYDSLFDEKVIKALTRRHYTGWGKLSAKLINGI<br>RDKQSQKTILDYLIDDGEINRNFMQLIHDDGLSFKEIIQKAQVFGKTDDVKQVVQELPGSPAIKK<br>LQSIKIVDELVKVMGKDPESIVVEMARENQFTNQGRRNSQQRYKRIENAIKNLDSNLNSKILKEHPT<br>DNQALQNDRLFLYYLQNGKDMYTGEELDINQLSSYDIDHIIPQAFIKDDSIDNRVLTSSKDNRGKSD<br>NVPSLEIVQKRKGFWQQLLNSKLISERKENNLTKAERGGLDERDKVGFIKRQLVETRQITKHVAQIL<br>DARFNTEVDEKGKRIRKVKIITLKSNLVSNFRKEFGLYKVREINDYHHAHDAYLNAVVAKAILKKY<br>PKLEPEFVYGDYQKYDIKRYISRSKDPKEIEKATEKYFFYSNLLNFFKEEVHYADGTIIKRENIEYSK<br>DTGEVAWNKEKDFATVRKVLSCPQVNIVKKTEVQTGGFSKESILPKRNSDKLIARKKDWDPKKYG<br>GFDSPTVAYSVLVVAKVEKGKSKKLKSVKELLGITIMERSSFEKNPIDFLEAKGYKEVRKDLIVKLP<br>KYSLFELENGRKRMLASAGELQKGNELALPSKYVNFLYLASHYEKLKGSPEDNEQKQLFVEQHKH<br>YLDEIIEQISEFSKRVILADANLDKVLSAYNKHRDKPIREQAENIIHLFTLTNLGAPAAFKYFDTTIDR<br>KRYTSTKEVLDATFIHQSITGLYETRIDLSQLGGD |
| 141 | MKKPYSIGLDIGTNSVGWAVITDDYKVPSKKMKVLGNTDKSHIKKNLIGALLFDSGNTAEDRRLK<br>RTARRRYTRRRNRILYLQEIFAEEMNKVDESFFHRLDDSFLVPEDKRGSKYPIFATLEEEKEYHKKF<br>PTIYHLRKHLADSKEKTDLRLIYLALAHMIKYRGHFLYEESFDIKNNDIQKIFNEFISIYDNTFEGSSL<br>SGQNAQVEAIFTDKISKSAKRERILKLFAYEKPTGLFSEFLKLIVGNQADFKKHFDLEEKAPLQFSK<br>DTYDEDLENLLGQIGDMYADLFLVAKKLYDAILLSGILTVTDPTTKAPLSASMIERYEEHQKDLAQ<br>LKEFVNQKLSEKYNEVESDVSKDGYAGYIEGKTTQENFYKFIKKAIEKIEGSDYFLDKINREDLLRK<br>QRTFDNGSIPHQIHLQEMHAIIRRQAEYYPFLAENQDKIEKILTFRIPYYVGPLARGKSEFAWLNRKS<br>DEKIRPWNFDEMVDKETSAENFITRMTNYDQYLPDQKVLPKHSLLYEKFAVYNELTKVRYVTEQG<br>KSFFFDANMKQEIFDGVFKVYRKVTKKKLMDFLAKEFDEFRIVDLMGLDKENKSFNASLGTYHDL<br>KKIVSKDFLDNPENEEILENVVLTLTLFEDREMIRKRLEKYKDVLTEEQRKKLERRHYTGWGRLSA<br>KLINGIRDKVTRKTILDYLIDDGTSNRNFMQLIHDDTLSFVDEIRLAQGSGEAEDYRTEVQNLAGSP<br>AIKKGILQSLKIVDELIEVMGYEPEHIVVEMARENQFTNQGRRNSQQRYNKIKEAIKNLDSNLNSKI<br>LKEYPTNNQALQNDRLFLYYLQNGKDMYTGEPLDINQLSSYDIDHIVPQAFIKDDSLDNRVLTSSK<br>DNRGKSDNVPSLEVVEKMKAFWQQLLDSKLISERKYNNLTKAERERGGLNELDKVGFIKRQLVET<br>RQITKHVAQILDARFNTEVNENNQKIRKVKIITLKSNLVSNFRKEFGLYKVREINDYHHAHDAYLN<br>AVVAKAILKKYPKLEPEFVYGDYQKYDIKRYISRSRDPKEIEKATEKYFFYSNLLNFFKEEVHYAD<br>GTIVKRENIEYSNDTGEIAWNKEKDFATVRKVLSCPQVNIVKKTEVQTGGFSKESILPKRNSDKLIA<br>RKKDWDPKKYGGFDSPTVAYSVLVVAKVEKGKSKKLKSVKELLGITIMERSSFEKNPIDFLEAKG<br>YKEVRKDLIVKLPKYSLFELENGRKRMLASAGELQKGNELALPSKYVNFLYLASHYEKLKGSPED<br>NEQKQLFVEQHKHYLDEIIEQISEFSKRVILADANLDKVLSAYNKHRDKPIREQAENIIHLFTLTNLG<br>APAAFKYFDTTIDRKRYTSTKEVLDATFIHQSITGLYETRIDLSQLGGD |
| 142 | MNKPYSIGLDIGTNSVGWAVITDSYKVPSKKMKVLGNTSKKYVKKNLLGALLFESGITAEGRRLK<br>RTARRRYTRRRNRILYLQEIFATEMNKVDESFFQRLDDSFLVPDDKRDSKYPIFGNLVEEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFVKANLPEKYDEVFSDQKSDGYAGYIDKTTQEAFYKYIKNLLSKFEGADYFLDKIEREDFL<br>RKQRTFDNGSIPHQIHLQEMNAILRRQGEHYPFLKDNKEKIEKILTFRIPYYVGPLARGNRDFAWLT<br>RNSDQAIRPWNFEEIVDKASSAEDFINKMTNYDLYLPEEKVLPKHSLLYETFAVYNELTKVKFIAEG<br>LRDYQFLDSGQKKQIVNQLFKEKRKVTEKDIIHYLHNVDGYDGIELKGIEKQFNASLSTYHDLLKII<br>KDKEFMDDPKNEEILENIVHTLTIFEDREMIKQRLEQYDSLFDEKVIKALTRRHYTGWGKLSAKLIN<br>GIRDKQSQKTILDYLIDDDKINRNFMQLINDDGLSFKEIIQKAQVVGKTDDVKQVVQELPGSPAIKK<br>GILQSIKIVDELVKVMGHAPENIVIEMARTNQGQKSSQDRKTRIENGVKNLASDLNGNILKEYPTDN<br>IQLQNDRLFLYYLQNGKDMYTGNPLDINQLSSYDIDHIVPQAFIKDDSLDNRVLTSSKDNRGKSDN<br>VPSIEIVQKRKAFWQQLLDSKLISERKENNLTKAERGGLDERDKVGFIKRQLVETRQITKHVAQILD<br>ARFNTEVNEKGRIRKVKIITLKSNLVSNFRKEFGLYKVREINDYHHAHDAYLNAVVAKAILKKYP<br>KLEPEFVYGDYQKYDIKRYISRSKEPKDIEKATEKYFFYSNLLNFFKEEVHYADGTIIKRENIEYSKD |

| SEQ ID NO | Nuclease Sequence |
|---|---|
| | TGEIAWNKEKDFATVRKVLSCPQVNIVKKTEVQTGGFSKESILPKRNSDKLIARKKDWDPKKYGG<br>FDSPTVAYSVLVVAKVEKGKSKKLKSVKELLGITIMERSSFEKNPIDFLEAKGYKEVRKDLIVKLPK<br>YSLFELENGRKRMLASAGELQKGNELALPSKYVNFLYLASHYEKLKGSPEDNEQKQLFVEQHKHY<br>LDEIIEQISEFSKRVILADANLDKVLSAYNKHRDKPIREQAENIIHLFTLTNLGAPAAFKYFDTTIDRK<br>RYTSTKEVLDATFIHQSITGLYETRIDLSQLGGD |
| 143 | MTKPYSIGLDIGTNSVGWAVITDSYKVPSKKMKVLGNTSKKYVKKNLLGALLFESGITAEGRRLK<br>RTARRRYTRRRNRILYLQEIFSTEMNKIDESFFQRLDDSFLVPDDKRDSKYPIFGNLVEEKTYHDEFP<br>TIYHLRKYLADSPKKADLRLVYLALAHMIKYRGHFLIEGDFNSRNNDIKKNFQEFLDSYNAIFESDL<br>SLENSKQLEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIDRYENHQKDLAA<br>LKQFVKANLPEKYDEVFSDQSKDGYAGYIDGKTTQEAFYKYIKNLLNKLEGADYFLDKIEREDFLR<br>KQRTFDNGSIPHQIHLQEMHAILHRQGEHYPFLKENREKIEKILTFRIPYYVGPLARGNRDFAWLTR<br>NSDQAIRPWNFEEVVDQASSAEEFINKMTNYDLYLPEEKVLPKHSLLYETFAVYNELTKVKFIAEG<br>LRDYQFLDSGQKKQIVNQLFKEKRKVTEKDIIHYLHNVDGYDGIELKGIEKQFNASLSTYHDLLKII<br>KDKEFMDDAKNEAILENIVHTLTIFEDREMIKQRLAQYNSLFDEKVIKALTRRHYTGWGRLSAKLI<br>NGIRDKQSKKTILDYLIDDDKINRNFMQLIHDDGLSFKEIIQKAQVGSHTDDLKQVVQELAGSPAIK<br>KGILQSLKIVDELIEVMGYDPEHIVVEMARENQFTNQGRRNSQQRYKKIEDAIKNLDSNLNSKILKE<br>YPTNNQALQNDRLFLYYLQNGKDMYTGEELDINQLSNYDIDHIVPQAFIKDDSLDNRVLTSSKDNR<br>GKSDNVPSIEVVQKRKAFWQQLLDSKLISERKENNLTKAERGGLDERDKVGFIKRQLVETRQITKH<br>VAQILDSRENTEVNDKGQKIRKVKIVTLKSNLVSNFRKEFGLYKVREINDYHHAHDAYLNAVVAK<br>AILKKYPKLEPEFVYGDYQKYDIKRYISRSKDPKDIEKATQKYFFYSNLLNFFKEEVHYADGTIIKR<br>ENIEYSKDTGEIAWNKEKDFATVRKVLSCPQVNIVKKTEVQTGGFSKESILPKRNSDKLIARKKDW<br>DPKKYGGFDSPTVAYSVLVVAKVEKGKSKKLKSVKELLGITIMERSSFEKNPIDFLEAKGYKEVRK<br>DLIVKLPKYSLFELENGRKRMLASAGELQKGNELALPSKYVNFLYLASHYEKLKGSPEDNEQKQLF<br>VEQHKHYLDEIIEQISEFSKRVILADANLDKVLSAYNKHRDKPIREQAENIIHLFTLTNLGAPAAFKY<br>FDTTIDRKRYTSTKEVLDATFIHQSITGLYETRIDLSQLGGD |
| 144 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHEKFP<br>TIYHLRKYLADSSKKADLRLVYLALAHMIKYRGHFLIEGDFNSRNNDIKKNFQNFLDSYNAIFESDL<br>SLENSKQLEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLAAL<br>KQFVKANLPEKYDEVFSDQSKDGYAGYIDGKTTQEAFYKYIKNLLSKFEGADYFLEKIEREDFLRK<br>QRTFDNGSIPHQIHLQEMNAILRRQGEHYPFLKENKEKIEKILTFRIPYYVGPLARGNRDFAWLTRN<br>SDQAIRPWNFEEIVDQASSAEDFINKMTNYDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLSTYHDLLKIIKD<br>KEFMDDPKNEEILENIVHTLTIFEDREMIKQRLAQYDSLFDEKVIKALTRRHYTGWGKLSAKLINGI<br>RDKQSNKTILDYLIDDDKINRNFMQLINDDGLSFKDIIQKAQVVGKTDDLKQVVQELPGSPAIKKGI<br>LQSIKIVDELVKVMGHAPESIVIEMARENQTTARGKKNSQQRYKRIEEALKNLAPGLDSKILKEHPT<br>DNTQLQNDKLFLYYLQNGRDMYIDEELDINRLSDYDIDHIVPQAFIKDDSLDNRVLTSSKDNRGKS<br>DNVPSLEVVQKRKGFWRQLLNSKLISKRKFDNLTKAERGGLTENDKAGFIKRQLVETRQITKHVA<br>QILDARFNTEVDENNKKIRKVKIITLKSNLVSNFRKEFELYKVREINDYHHAHDAYLNAVVAKAIL<br>KKYPKLEPEFVYGDYQKYDIKRYISRSKDPKEVEKATEKYFFYSNLLNFFKEEVHYADGTIIKRENI<br>EYSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 145 | MNKPYSIGLDIGTNSVGWAVITDDYKVPSKKMKVLGNTSKKYVKKNLLGALLFESGITAEGRRLK<br>RTARRRYTRRRNRILYLQEIFPEKGMSEIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQQFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLAT<br>LKQFVKTNLPEKYDEVFSDQSKDGYAGYIDGKTTQEAFYKYIKNLLSKFEGSDYFLDKIEREDFLR<br>KQRTFDNGSIPHQIHLQEMNAIIRRQGEHYPFLKENREKIEKILTFRIPYYVGPLARGNRDFAWLTRN<br>SDQAIRPWNFEEIVDKASSAEEFINKMTNYDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLSTYHDLLKIIRD<br>KEFMDDPKNEEILENVVHTLTIFEDREMIKQRLAQYDSLFDEKVIKALSRRHYTGWGRLSAKLINGI<br>RDKQSQKTILDYLIDDGEINRNFMQLIHDDGLSFKEIIQKAQVVSHSDDLKQVVQELPGSPAIKKGIL<br>QSIKIVDELVKVMGHNPESIVIEMARENQTTNQGRRNSQQRYKKINEAIKNLDSNLNSKILKEYPTN<br>NQALQNDRLFLYYLQNGKDMYTGEALDINQLSNYDIDHIIPQAFIKDDSLDNRVLTSSKDNRGKSD<br>NVPSIEVVEKMKGFWQQLLDSKLISERKENNLTKAERGGLDERDKVGFIKRQLVETRQITKHVAQL<br>LDARFNVEVNDKKQRIRNVKIITLKSNLVSNFRKEFGLYKVREINDYHHAHDAYLNAVVAKAILK<br>KYPKLEPEFVYGDYQKYDVRKFIKSKSEQEIGKATAKKFFYSNLLNFFKKEVRLADGTVIVRPVVE<br>YSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 146 | MKKPYSIGLDIGTNSVGWAVVTDDYKVPAKKMKVLGNTDKSHIKKNLLGALLFDSGNTAEDRRL<br>KRTARRRYTRRRNRILYLQEIFAEEMNKVDESFFHRLDDSFLVPEDKRGSKYPIFATLEEEKEYHKK |

| SEQ ID NO | Nuclease Sequence |
|---|---|
| | FPTIYHLRKHLADSKEKTDLRLIYLALAHMIKYRGHFLYEESFDIKNNDIQKIFNEFISIYDNTFEGSS LSGQNAQVEAIFTDKISKSAKRERVLKLFPDEKSTGLFSEFLKLIVGNQADFKKHFDLEEKAPLQFS KDTYDEDLENLLGQIGDDFADLFLVAKKLYDAILLSGILTVKDLSTKAPLSASMIERYENHQEDLK QLKRFVNQKLSEKYNEVESDDSKDGYAGYIEGKTNQEGFYKYIKNLIEKLEGADYFLEKINREDLL RKQRTFDNGSIPHQIHLQEMHAIIRRQAEFYPPLAENQDKIEKILTFRIPYYVGPLARGKSEFAWLNR KSDEKIRPWNFDEMVDKETSAENFITRMTNYDQYLPDQKVLPKHSLLYEKFAVYNELTKVRYTE QGKSFFFDANMKQEIFDGVFKVYRKVTKEKLLDFLDKEFDEFRIVDLIGLDKENKAFNASLGTYHD LKKIVSKDFLDNPENEDILENVVLTLTLFEDREMIRKRLEKYKDVLTEEQRKKLERRHYTGWGRLS AKLINGIRNKTTRKTILDYLIDDGTSNRNFMQLIHDDTLSFVDEIRLAQGSGEAEDYRAEVQNLAGS PAIKKGILQSLKIVDELIEVMGYDPEHIVVEMARENQFTNQGRRNSQQRYKKIKDAIKNLDSNLNSK ILKEYPTNNQALQNDRLFLYYLQNGKDMYTGKELDINQLSNYDIDHIVPQAFIKDDSLDNRVLTSS KDNRGKSDNVPSLEVVQKRKAFWQQLLDSKLISERKYNNLTKAERERGGLNELDKVGFIKRQLVE TRQITKHVAQILDARFNTEVDENGKRIRKVKIITLKSNLVSNFRKEFGLYKVREINDYHHAHDAYL NAVVAKAILKKYPKLEPEFVYGDYQKYDIKRYISRSKDPKDIEKATEKYFFYSNLLNFFKEEVHYA DGTIIKRENIEYSKDTGEIAWNKEKDFATVRKVLSCPQVNIVKKTEVQTGGFSKESILPKRNSDKLIA RKKDWDPKKYGGFDSPTVAYSVLVVAKVEKGKSKKLKSVKELLGITIMERSSFEKNPIDFLEAKG YKEVRKDLIVKLPKYSLFELENGRKRMLASAGELQKGNELALPSKYVNFLYLASHYEKLKGSPED NEQKQLFVEQHKHYLDEIIEQISEFSKRVILADANLDKVLSAYNKHRDKPIREQAENIIHLFTLTNLG APAAFKYFDTTIDRKRYTSTKEVLDATFIHQSITGLYETRIDLSQLGGD |
| 147 | MTKPYSIGLDIGTNSVGWAVITDSYKVPSKKMKVLGNTSKKYVKKNLLGALLFESGITAEGRRLK RTARRRYTRRRNRILYLQEIFSTEMAKIDESFFQRLDDSFLVPDDKRDSKYPIFGNLVKEKTYHDEF PTIYHLRKYLADSSKKADLRLVYLALAHMIKYRGHFLIEGDFNSRNNDIKKNFQDFLDSYNAIFESD LSLENSKQLEEIVKDKISKSAKKDRLLKLFPGEKNSGIFSEFLKLIVGNQADFRKYFNLDEKASLHES KESYDEDLETLLGHIGDDYSDVFLKAKKLYDAILLSGILTVTDNETEAPLSSAMIMRYKEHEEDLAL LKAYIRKISLETYNEVFKDDTKNGYAGYIDGKTNQEDFYVYLKKLLTGLEGADYFLEKINREDLLR KQRTFDNGSIPYQIHLQEMRAIIDKQAKFYPPLAKNKERIEKILTFRIPYYVGPLARGNSDFAWSIRK RNEKITPWNFEDVIDKESSAEAFINRMTSFDLYLPEEKVLPKHSLLYETFTVYNELTKVRFIAESMR DYQFLDSKQKKDIVRLYFKGKRKVTDKDIIDYLHAIDGYDGIELKGIEKQFNSSLSTYHDLLKIIKD KEFLDDASNEAIIEEIIHTLTIFEDREMIKQRLSKFENIFDKSVLKKLSRRHYTGWGKLSAKLINGIRD EKSGKTILDYLIDDGVSNRNFMQLIHDDTLSFKKKIQKAQIIGDQDNIKQVVQSLPGSPAIKKGILQSI KIVDELVKVMGRNPESIVVEMARENQYTNQGKSNSQQRLKRLEESLKELGSKILKENVPAKLSKID NNALQNERLYLYYLQNGKDMYTGDDLDIDRLSNYDIDHIIPQAFLKDNSIDNKVLVSSASNRGKSD DVPSLDVVKKRKTFWHQLLKSKLISQRKFDNLTKAERGGLTEDDKAGFIQRQLVETRQITKHVARI LDERFNNELDENGKRIRKVKIITLKSSLVSQFRKEFGLYKVREINDYHHAHDAYLNAVVATAILKK YPKLEPEFVYGEYKKYEVKSTYGEKKEYVREIVRSKTDSSLGKATAKMFFYSNLMNFFKKEVRLS DGTVIVRPVIEYSKDTGEIAWNKEKDFATVRKVLSCPQVNIVKKTEVQTGGFSKESILPKRNSDKLI ARKKDWDPKKYGGFDSPTVAYSVLVVAKVEKGKSKKLKSVKELLGITIMERSSFEKNPIDFLEAK GYKEVRKDLIVKLPKYSLFELENGRKRMLASAGELQKGNELALPSKYVNFLYLASHYEKLKGSPE DNEQKQLFVEQHKHYLDEIIEQISEFSKRVILADANLDKVLSAYNKHRDKPIREQAENIIHLFTLTNL GAPAAFKYFDTTIDRKRYTSTKEVLDATFIHQSITGLYETRIDLSQLGGD |
| 148 | MKKYSIGLDIGTNSVGWAVVDDDYKVPAKKMRVFGDTDRSHIKKNLLGTLLFDSGETAENRRLK RTARRRYTRRRNRILYLQEIFAKEMAKVDESFFHRLDESFLTDDDKTFDSHPIFGNKAEEDAYHQK FPTIYHLRKHLADSTEKADLRLVYLALAHMIKFRGHFLIEGELNAENTDVQKLFAQFVGVYDRTFD DSHLSEITVDASSILTEKISKSRRLENLIKHYPTEKKNTLFGNLVALALGLQPNFKTNFKLSEDAKLQ FSKDTYEEDLEELLGKIGDEYADLFTSAKNLYDAILLSGILTVDDNSTKAPLSASMIKRYVEHHEDL EKLKEFIKANKPDFYHDIFKDKDKNGYAGYIENGVKQDEFYKYLKNTLSKIAGSDYFLDKIEREDF LRKQRTFDNGSIPHQIHLQEMHAILRRQGEYYPFLKENQAKIEKILTFRIPYYVGPLARKDSRFAWA NYHSDEPITPWNFDEVVDKEKSAEKFITRMTLNDLYLPEEKVLPKHSLVYETYTVYNELTKIKYVN EQGKETFFDANMKQEIFEHVFKENRKVTKEKFLNYLNKEFPEYRIQDLIGLDKENKSFNASLGTYH DLKKILDKSFLDDKTNEQIIEDIIQTLTLFEDRDMIRQRLQKYSDIFTKQQLKKLERRHYTGWGRLS YKLINGIRNKENNKTILDYLIDDGYANRNFMQLINDDTLPFKQIIQKSQVVGDIDDIKAVVHDLPGS PAIKKGILQSVKIVDELVKVMGHNPDNIVIEMARENQTTNRGRTQSQQRLKKLQDSLKELGSNILN EEKPSYVEGKVENNHLQNDKLFLYYIQNGKDMYTGEELDIDHLSYDIDHIIPQAFIKDDSIDNRVL TSSAKNRGKSDDVPSLDIVHDRKADWIRLYKSGLISKRKFDNLTKAERGGLTEADKAGFIKRQLVE TRQITKHVAQILDARFNTKRDENDKVIRDVKVITLKSNLVSQFRKDFQFYKVREINDYHHAHDAYL NAVVGTALLKKYPKLAPEFVYGEYKKYDIRKFITNSSDKATAKYFFYSNLNFFKTKVRYADGTVI VRPVIEYSKDTGEIAWNKEKDFATVRKVLSCPQVNIVKKTEVQTGGFSKESILPKRNSDKLIARKKD WDPKKYGGFDSPTVAYSVLVVAKVEKGKSKKLKSVKELLGITIMERSSFEKNPIDFLEAKGYKEVR KDLIVKLPKYSLFELENGRKRMLASAGELQKGNELALPSKYVNFLYLASHYEKLKGSPEDNEQKQ LFVEQHKHYLDEIIEQISEFSKRVILADANLDKVLSAYNKHRDKPIREQAENIIHLFTLTNLGAPAAF KYFDTTIDRKRYTSTKEVLDATFIHQSITGLYETRIDLSQLGGD |
| 149 | MKKYSIGLDIGTNSVGWAVVDDDYKVPAKKMRVFGDTDRSHIKKNLLGTLLFDSGETAESRRLKR TARRRYTRRRNRILYLQEIFAEEMNKVDDSFFHRLDESFLTDDDKTFDSHPIFGNKAEEDAYHQKFP TIYHLRKHLADSTEKADLRLVYLALAHMIKFRGHFLIEGELNAENTDVQKLFAQFVGVYDRTFDDS HLSEITVDASSILTEKISKSRRLENLIKHYPTEKKNTLFGNLVALALGLQPNFKTNFKLSEDAKLQFS KDTYEEDLEELLGKIGDDYADLFTSAKNLYDAILLSGILTVDDESTKAPLSASMVKRYAEHHEDLE KLKEFIKANKPELYHDIFKDETKNGYAGYIENGVKQDEFYKYLKTTLSKIEGSDYFLDKIEREDFLR KQRTFDNGSIPHQIHLQEMHAILRRQGDYYPFLKENQAKIEKILTFRIPYYVGPLARKDSRFAWANY HSDEPITPWNFDEVVDKEKSAEKFITRMTINDLYLPEEKVLPKHSHVYETYAVYNELTKIKYVNEQ GKSFFFDANMKQEIFEHVFKENRKVTKDKFLNYLNKEFPEYRIQDLIGLDKENKSFNASLGTYHDL KKILDKSFLDDKTNEQIIEDIVLTLTLFEDRDMIRQRLQKYSDIFTPQQLKKLERRHYTGWGRLSYK |

| SEQ ID NO | Nuclease Sequence |
|---|---|
| | LINGIRNKENNKTILDFLIDDGHANRNFMQLINDDSLSFKTIIQEAQVVGDVDDIEAVVHDLPGSPAI
KKGILQSVKIVDELVKVMGHNPDNIVIEMARENQTTNRGRSQSQQRLKKLQDSLKELGSNILNEEK
PSYIEDKVENSHLQNDKLFYYIQNGKDMYTGEELDIDHLSDYDIDHIIPQAFIKDDSIDNRVLTSSA
KNRGKSDDVPSLDIVHDRKADWIRLYKSGLISKRKFDNLTKAERGGLTEADKAGFIKRQLVETRQI
TKHVAQILDARFNTERDENDKVIRDVKVITLKSNLVSQFRKDFQFYKVREINDYHHAHDAYLNAV
VGTALLKKYPKLAPEFVYGEYKKYDIRKFITNSSDKATAKYFFYSNLLNFFKTKVRYADGTVIVRP
VIEYSKDTGEIAWNKEKDFATVRKVLSCPQVNIVKKTEVQTGGFSKESILPKRNSDKLIARKKDWD
PKKYGGFDSPTVAYSVLVVAKVEKGKSKKLKSVKELLGITIMERSSFEKNPIDFLEAKGYKEVRKD
LIVKLPKYSLFELENGRKRMLASAGELQKGNELALPSKYVNFLYLASHYEKLKGSPEDNEQKQLFV
EQHKHYLDEIIEQISEFSKRVILADANLDKVLSAYNKHRDKPIREQAENIIHLFTLTNLGAPAAFKYF
DTTIDRKRYTSTKEVLDATFIHQSITGLYETRIDLSQLGGD |
| 150 | MKKPYSIGLDIGTNSVGWAVVTDDYKVPAKKMKVLGNTDKSHIKKNLLGALLFDSGETAEATRL
KRTARRRYTRRRNRILYLQEIFAKEMAKVDESFFHRLDESFLTDDDKNFDSHPIFGNKAEEDAYHQ
KFPTIYHLRKHLADSTEKADLRLVYLALAHMIKFRGHFLIEGQLNAENTDVQTLFNDFVEVYDKTV
EESHLSEITVDALSILTEKVSKSRRLENLIKYYPTEKKNTLFGNLIALALGLQPNFKTNFKLSEDAKL
QFSKDTYEEDLEELLGKIGDEYADLFTSAKNLYDAILLSGILTVDDESTKAPLSASMIKRYAEHHED
LEKLKEFIKANKPELYHDIFKDETKNGYAGYIENGVKQDEFYKYLKNTLTKIEGSDYFLDKIEREDF
LRKQRTFDNGSIPHQIHLQEMHAILRRQGDYYPFLKENQDRIEKILTFRIPYYVGPLARKDSRFAWA
NYHSDEPITPWNFDEVVDKEKSAEKFITRMTLNDLYLPEEKVLPKHSHVYETYAVYNELTKIKYVN
EQGKESFFDANMKQEIPEHVFKENRKVTKEKFLNYLNKEFPEYRIQDLIGLDKENKSFNASLGTYH
DLKKILDKSFLDDKTNEQIIEDIIQTLTLFEDRDMIRQRLQKYSDIFTKQQLKKLERRHYTGWGRLS
YKLINGIRNKENNKTILDYLIDDGYANRNFMQLINDDTLPFKQIIQKSQVIGDIDDIKAVVHDLPGSP
AIKKGILQSVKIVDELVKVMGDNPDNIVIEMARENQTTNRGRTQSQQRLKKLQESLKELGSNILNE
EKPSYIEDKVENSHLQNDKLFYYIQNGKDMYTGEELDIDHLSDYDIDHIIPQAFIKDDSIDNRVLTS
SAKNRGKSDDVPSLDIVHDRKADWIRLYKSGLISRKFDNLTKAERGGLTEADKAGFIKRQLVETR
QITKHVAQILDARFNTERDENDKVIRDVKVITLKSNLVSQFRKDFQFYKVREINDYHHAHDAYLNA
VVGTALLKKYPKLAPEFVYGEYKKYDIRKFITASGDKATAKYFFYSNLLNFFKTKVRYADGTVIVR
PVIEYSKDTGEIAWNKEKDFATVRKVLSCPQVNIVKKTEVQTGGFSKESILPKRNSDKLIARKKDW
DPKKYGGFDSPTVAYSVLVVAKVEKGKSKKLKSVKELLGITIMERSSFEKNPIDFLEAKGYKEVRK
DLIVKLPKYSLFELENGRKRMLASAGELQKGNELALPSKYVNFLYLASHYEKLKGSPEDNEQKQLF
VEQHKHYLDEIIEQISEFSKRVILADANLDKVLSAYNKHRDKPIREQAENIIHLFTLTNLGAPAAFKY
FDTTIDRKRYTSTKEVLDATFIHQSITGLYETRIDLSQLGGD |
| 151 | MSNKPYSIGLDIGTNSVGWAVVTDDYKVPAKKMKVLGDTDKSHIKKNLLGALLFEGGETAEGRR
LKRTARRRYTRRRNRILYLQEIFAEEMNKVDESFFHRLDDSFLVPEDKRGSKYPIFATLEEEKEYHK
KFPTIYHLRKHLADSKEKTDLRLIYLALAHMIKYRGHFLYEESFDIKNNDIQKIFNEFISIYDNTFEGS
SLSGQNAQVEAIFTDKISKSAKRERVLKLFPDEKSTGLFSEFLKLIVGNQADFKKHFDLEEKAPLQFS
KDTYEDLENLLGQIGDDFADLFLVAKKLYDAILLSGILTVTDPSTKAPLSASMIQRYEEHQEDLKK
LKQFIKRNIPEKYDEVFSDQSKNGYAGYIDGKTTQEEFYKYLKEKLTSVKGADYFLEKIKNEDFLR
KQRTFDNGVIPYQVHLSEMRAILHRQGEYYPFLKENKEKIEKILTFRIPYYVGPLARGNRDFAWLTR
NSDEAIRPWNFEEVVDKASSAEDFINKMTNYDLYLPEEKVLPKHSLLYEKFAVYNELTKVRYVTE
QGKSFFFDANMKQEIFDKTFKVYRKVTKEKLMDFLGKEFDEFRIVDLMGLDKDNKSFNASLGTYH
DLKKIVSKDFLDNPENEDILENVVLTLTLFEDREMIRKRLEKYKDVLTEEQRKKLERRHYTGWGRL
SAKLINGIRDKVTRKTILDYLIDDGTSNRNFMQLIHDDTLSFVDEIRLAQGSGEAEDYRTEVQNLAG
SPAIKKGILQSLKIVDELIEVMGYDPEHIVVEMARENQFTNQGRRNSQQRYKKIENAIKNLDSNLNS
KILKEYPTNNQALQNDRLFLYYLQNGKDMYTGEALDINQLSNYDIDHIIPQAFIKDDSLDNRVLTSS
KDNRGKSDNVPSLEVVEKMKAFWQQLLDSKLISERKYNNLTKAERERGGLNELDKVGFIKRQLVE
TRQITKHVAQILDARFNTEVNEKNQKIRKVKIITLKSNLVSNFRKEFGLYKVREINDYHHAHDAYL
NAVVAKAILKKYPKLEPEFVYGDYQKYDIKRYISRSKDPKDIEKATEKYFFYSNLLNFFKHKEEVHYA
DGTIIKRENIEYSKDTGEIAWNKEKDFATVRKVLSCPQVNIVKKTEVQTGGFSKESILPKRNSDKLIA
RKKDWDPKKYGGFDSPTVAYSVLVVAKVEKGKSKKLKSVKELLGITIMERSSFEKNPIDFLEAKG
YKEVRKDLIVKLPKYSLFELENGRKRMLASAGELQKGNELALPSKYVNFLYLASHYEKLKGSPED
NEQKQLFVEQHKHYLDEIIEQISEFSKRVILADANLDKVLSAYNKHRDKPIREQAENIIHLFTLTNLG
APAAFKYFDTTIDRKRYTSTKEVLDATFIHQSITGLYETRIDLSQLGGD |
| 152 | MKKSYSIGLDIGTNSVGWAVVDDDYKVPAKKMRVFGDTDRSHIKKNLLGTLLFDSGETAESRRLK
RTARRRYTRRRNRILYLQEIFAEEMNKVDDSFFHRLDESFLTDDDKNFDSHPIFGNKAEEDAYHQK
FPTIYHLRKHLADSTEKADLRLVYLALAHMIKFRGHFLIEGQLNAENTDVQTLFNDFVEVYDKTVE
ESHLSEITVDALSILTEKVSKSRRLENLIKYYPTEKKNTLFGNLIALALGLQPNFKTNFKLSEDAKLQ
FSKDTYEEDLEELLGKIGDEYADLFTSAKNLYDAILLSGILTVDDNSTKAPLSASMLKRYVEHHEDL
EKLKEFIKANKSELYHDIFKDENKNGYAGYIENGVKQDEFYKYLKNTLSKIAGSDYFLDKIEREDFL
RKQRTFDNGSIPHQIHLQEMHAILRRQGDYYPFLKENQDRIEKILTFRIPYYVGPLARKDSRFAWAN
YHSDEPITPWNFDEVVDKEKSAEKFITRMTLNDLYLPEEKVLPKHSHVYETYAVYNELTKIKYVNE
QGKSFFFDANMKQEIFEHVFKENRKVTKDKFLNYLNKEFPEYRIQDLIGLDKENKSFNASLGTYHD
LKKILDKSFLDDKTNEQIIEDIIQTLTLFEDRDMIRQRLQKYSDIFTKQQLKKLERRHYTGWGRLSY
KLINGIRNKENNKTILDYLIDDGYANRNFMQLINDDTLPFKQIIQEAQVVGDVDDIEAVVHDLPGSP
AIKKGILQSVKIVDELVKVMGHNPDNIVIEMARENQTTNRGRTQSQQRLKKLQESLKELGSNILNE
EKPSYVEGKVENNQLQNDRLFYYIQNGKDMYTGEELDIDHLSDYDIDHIIPQAFIKDDSIDNRVLT
SSAKNRGKSDDVPSLDIVHDRKADWIRLYKSGLISKRKFDNLTKAERGGLTEADKAGFIKRQLVET
RQITKHVAQILDSRFNTKRDENDKVIRDVKVITLKSNLVSQFRKDFQFYKVREINDYHHAHDAYLN
AVVGTALLKKYPKLAPEFVYGEYKKYDIRKFITASGDKATAKYFFYSNLLNFFKTKVRYADGTVIV
RPVIEYSKDTGEIAWNKEKDFATVRKVLSCPQVNIVKKTEVQTGGFSKESILPKRNSDKLIARKKD
WDPKKYGGFDSPTVAYSVLVVAKVEKGKSKKLKSVKELLGITIMERSSFEKNPIDFLEAKGYKEVR |

| SEQ ID NO | Nuclease Sequence |
|---|---|
|  | KDLIVKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDATFIHQSITGLYETRIDLSQLGGD |
| 153 | MKKPYSIGLDIGTNSVGWAVITDDYKVPSKKMKVLGNTDKSHIKKNLIGALLFDSGNTAEDRRLK<br>RTARRRYTRRRNRILYLQEIFSEEMNKVDESFFHRLDDSFLVPEDKRGSKYPIFATLEEEKEYHKKF<br>PTIYHLRKHLADSKEKTDLRLIYLALAHMIKYRGHFLYEESFDIKNNDIQKIFNEFISIYDNTFEGSSL<br>SGQNAQVEAIFTDKISKSAKRERVLRLFPDEKSTGLFSEFLKLIVGNQADFKKHFELEEKAPLQFSK<br>DTYDEDLEELLGKIGDDYADLFVAAKKLYDAILLSGILTVTDSTTKAPLSSSMVNRYEEHQKDLAL<br>LKQFVRTNLPEKYAEVFSDASKDGYAGYIEGKTTQENFYKFIKKAIEKIEGSDYFLDKIEREDFLRK<br>QRTFDNGSIPHQIHLQEMHAIIRRQAEFYPFLAENQDKIEKILTFRIPYYVGPLARGKSEFAWLNRKS<br>DEKIRPWNFDEMVDKETSAENPITRMTNYDQYLPDQKVLPKHSLLYEKFAVYNELTKVRYVTEQG<br>KSFFFDANMKQEIFDGVFKVYRKVTKEKLMDFLGKEFDEFRIVDLMGLDKDNKSFNASLGTYHDL<br>KKIVSKDFLDNPENEDILENVVLTLTLFEDREMIRKRLEKYKDVLTEEQRKKLERRHYTGWGRLSA<br>KLINGIRDKVTRKTILDYLIDDGTSNRNFMQLIHDDTLSFVDEIRLAQGSGEAEDYRAEVQNLAGSP<br>AIKKGILQSLKIVDELIEVMGYDPEHIVVEMARENQFTNQGRRNSQQRYKKIKDAIKNLDSNLNSKI<br>LKEYPTNNQALQNDRLFLYYLQNGKDMYTGEALDINQLSNYDIDHIIPQAFIKDDSLDNRVLTSSK<br>DNRGKSDNVPSLEVVEKMKAFWQQLLDSKLISERKYNNLTKAERERGGLNELDKVGFIKRQLVET<br>RQITKHVAQILDARFNTEVDENNQRIRKVKIITTLKSNLVSNFRKEFGLYKVREINDYHHAHDAYLN<br>AVVAKAILKKYPKLEPEFVYGDYQKYDIKRYISRSKDPKEIEKATEKYFFYSNLLNFFKEEVHYAD<br>GTIVKRENIEYSKDTGEIAWNKEKDFATVRKVLSCPQVNIVKKTEVQTGGFSKESILPKRNSDKLIA<br>RKKDWDPKKYGGFDSPTVAYSVLVVAKVEKGKSKKLKSVKELLGITIMERSSFEKNPIDFLEAKG<br>YKEVRKDLIVKLPKYSLFELENGRKRMLASAGELQKGNELALPSKYVNFLYLASHYEKLKGSPED<br>NEQKQLFVEQHKHYLDEIIEQISEFSKRVILADANLDKVLSAYNKHRDKPIREQAENIIHLFTLTNLG<br>APAAFKYFDTTIDRKRYTSTKEVLDATFIHQSITGLYETRIDLSQLGGD |
| 154 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKADLRLVYLALAHMIKYRGHFLIEGDFNSRNNDIKKNFQDFLDSYNAIFESDL<br>SLENSKQLEEIVKDKISKSAKKDRLLKLFPGEKNSGIFSEFLKLIVGNQADFRKYFNLDEKASLHFSK<br>ESYDEDLETLLGHIGDDYSDVFLKAKKLYDAILLSGILTVTDNETEAPLSSAMIMRYKEHEEDLALL<br>KAYIRNISLETYNEVFKDDTKNGYAGYIDGKTNQEDFYVYLKKLLTGLEGADYFLEKINREDLLRK<br>QRTFDNGSIPYQIHLQEMRAIIDKQAKFYPPLAKNKERIEKILTFRIPYYVGPLARGNSDFAWSIRKR<br>NEKITPWNFEDVIDKESSAEAFINRMTSFDLYLPEEKVLPKHSLLYETFTVYNELTKVRFIAESMRD<br>YQFLDSKQKKDIVRLYFKGKRKVTDKDIIEYLHAIDGYDGIELKGIEKQFNSSLSTYHDLLKIIKDKE<br>FLDDSSNEAIIEEIIHTLTIFEDREMIKQRLSKFENIFDKSVLKKLSRRHYTGWGKLSAKLINGIRDEK<br>SGKTILDYLIDDGISNRNFMQLIHDDTLSFKKKIQKAQIIGDQDNIKQVVQSLPGSPAIKKGILQSIKI<br>VDELVKVMGRNPESIVVEMARENQYTNQGKSNSQQRLKRLEESLKELGSKILKEKVPVKLSKIDN<br>KALQNERLYLYYLQNGKDMYTGDDLDIDRLSNYDIDHIIPQAFLKDNSIDNKVLVSSASNRGKSDD<br>VPSLDVVKKRKTFWHQLLKSKLISQRKFDNLTKAERGGLTEADKAGFIKRQLVETRQITKHVAQIL<br>DARFNTKRDDNDKLIREVKIITLKSSLVSQFRKEFQLYKVREINDYHHAHDAYLNAVVATALLKKY<br>PKLAPEFVYGEYNRYKSDKKTKRVSVMSDLTVLFRDNVEYSNDTGEIAWNKEKDFATVRKVLSC<br>PQVNIVKKTEVQTGGFSKESILPKRNSDKLIARKKDWDPKKYGGFDSPTVAYSVLVVAKVEKGKS<br>KKLKSVKELLGITIMERSSFEKNPIDFLEAKGYKEVRKDLIVKLPKYSLFELENGRKRMLASAGELQ<br>KGNELALPSKYVNFLYLASHYEKLKGSPEDNEQKQLFVEQHKHYLDEIIEQISEFSKRVILADANLD<br>KVLSAYNKHRDKPIREQAENIIHLFTLTNLGAPAAFKYFDTTIDRKRYTSTKEVLDATFIHQSITGLY<br>ETRIDLSQLGGD |
| 155 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKKDRLLKLFPGEKNSGIFSEFLKLIVGNQADFRKYFNLDEKASLHES<br>KESYDEDLETLLGHIGDDYSDVFLKAKKLYDAILLSGILTVTDNETEAPLSSAMIMRYKEHEEDLAL<br>LKAYIRKISLETYNEVFKDDTKNGYAGYIDGKTNQEDFYVYLKKLLTGLEGADYFLEKINREDLLR<br>KQRTFDNGSIPYQIHLQEMRAIIDKQAKFYPLAKNKERIEKILTFRIPYYVGPLARGNSDFAWSIRK<br>RNEKITPWNFEDVIDKESSAEAFINRMTSFDLYLPEEKVLPKHSLLYETFTVYNELTKVRFIAESMR<br>DYQFLDSKQKKDIVRLYFKGKRKVTDKDIIEYLHAIDGYDGIELKGIEKQFNSSLSTYHDLLNIINDK<br>EFLDDSSNEAIIEEIIHTLTIFEDREMIKQRLSKFENIFDKSVLKKLSRRHYTGWGKLSAKLINGIRDE<br>KSGKTILDYLIDDGVSNRNFMQLIHDDTLSFKKKIQKAQIIGDQDNIKQVVQSLPGSPAIKKGILQSI<br>KIVDELVKVMGRNPESIVVEMARENQYTNQGKSNSQQRLKRLEESLKELGSKILKENVPVKLSKID<br>NNALQNDRLYLYYLQNGKDMYTGEELDIDNLSNYDIDHIIPQAFLKDDSIDNKVLVSSASNRGKSD<br>DVPSLEVVRRRKNFWKQLLDSQLISQRKFDNLTKAERGGLTDDDKAGFIKRQLVETRQITKHVAQI<br>LDARFNTKRDDNDKVIRNKLIITLKSSLVSQFRKEFGLYKVREINDYHHAHDAYLNAVVATAILKK<br>YPKLEPEFVYGDYQKYDVRKYLSTKDNKDLGKATAKMFFYSNLMNFFKKEVRLSDGTVVVRPVI<br>EYSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 156 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKADLRLVYLALAHMIKYRGHFLIEGDFNSRNNDIKKNFQDFLDSYNAIFESDL<br>SLENSKQLEEIVKDKISKSAKKDRLLKLFPGEKNSGIFSEFLKLIVGNQADFRKYFNLDEKASLHFSK |

| SEQ ID NO | Nuclease Sequence |
|---|---|
| | ESYDEDLETLLGHIGDDYSDVFLKAKKLYDAILLSGILTVTDNETEAPLSSAMIMRYKEHEEDLALL<br>KAYIRKISLETYNEVFKDDTKNGYAGYIDGKTNQEDFYAYLKKLLTGLEGADYFLEKINREDLLRK<br>QRTFDNGSIPHQIHLQEMHAILRKQEKFYPFLAKNKERIEKILTFRIPYYVGPLARGNSDFAWSIRKR<br>NEKITPWNFEDVIDKESSAEAFINRMTSFDLYLPEEKVLPKHSLLYETFTVYNELTKVRFIAESMRD<br>YQFLDSKQKKDIVRLYFKGKRKVTDKDIIDYLHAIDGYDGIELKGIEKQFNSSLSTYHDLLNIINDKE<br>FLDDSSNEAIIEEIIHTLTIFEDREMIKQRLSKFENIFDKSVLKKLSRRHYTGWGKLSAKLINGIRDEK<br>SGKTILDYLIDDGVSNRNFMQLIHDDTLSFKKKIQKAQIIGDQDNIKQVVQSLPGSPAIKKGILQSIKI<br>VDELVKVMGRNPESIVVEMARENQYTNQGKSNSQQRLKRLEESLKELGSKILKENVPAKLSKIDN<br>NALQNERLYLYYLQNGKDMYTGDDLDIDRLSNYDIDHIIPQAFLKDNSIDNKVLVSSASNRGKSDD<br>VPSIDVVKKRKTFWHQLLKSQLISQRKFDNLTKAERGGLTEDDKAGFIKRQLVETRQITKHVAQIL<br>DSRENTEVNDKGKKIRKVKIITLKSSLVSQFRKEFGLYKVREINDYHHAHDAYLNAVVATAILKKY<br>PKLEPEFVYGDYQSYSLGHDKIVDVSKLIVKSDSSLGKATAKMFFYSNLMNFFKKKVRLSDGTVV<br>VRPVVEYSNDTGEIAWNKEKDFATVRKVLSCPQVNIVKKTEVQTGGFSKESILPKRNSDKLIARKK<br>DWDPKKYGGFDSPTVAYSVLVVAKVEKGKSKKLKSVKELLGITIMERSSFEKNPIDFLEAKGYKEV<br>RKDLIVKLPKYSLFELENGRKRMLASAGELQKGNELALPSKYVNFLYLASHYEKLKGSPEDNEQK<br>QLFVEQHKHYLDEIIEQISEFSKRVILADANLDKVLSAYNKHRDKPIREQAENIIHLFTLTNLGAPAA<br>FKYFDTTIDRKRYTSTKEVLDATFIHQSITGLYETRIDLSQLGGD |
| 157 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDEGFFQRLDDSFLVPDDKRDSKYPIFGNLVEEKVYHEEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIQNNLQEKYDEVFSDQSKDGYAGYIDGKTTQEAFYKYIKNLLSKLEGADYFLDKIEREDFL<br>RKQRTFDNGSIPHQIHLQEMNAIIRRQGEHYPFLKENKEKIEKILTFRIPYYVGPLARGNRDFAWLTR<br>NSDQAIRPWNFEEIVDKASSAEDFINKMTNYDLYLPEEKVLPKHSLLYETFAVYNELTKVKFIAEGL<br>RDYQFLDSGQKKQIVNQLFKEKRKVTEKDIIHYLHNVDGYDGIELKGIEKQFNASLSTYHDLLKIIK<br>DKEFMDDPKNEEILENIVHTLTIFEDREMIKQRLAQYDSLFDEKVIKALTRRHYTGWGKLSAKLING<br>IYDKQSRKTILDYLIDDDKINRNFMQLIHDDGLSFKEIIQKAQVFGKTDDVKQVVQELPGSPAIKKGI<br>LQSIKIVDELVKVMGHAPESIVIEMARENQTTNQGKRNSQQRYKRIEDAIKNLSVDLNSKILKEYPT<br>DNQALQNDRLFLYYLQNGKDMYTGEALDINQLSNYDIDHIIPQAFIKDDSLDNRVLTSSKDNRGKS<br>DDVPSIEVVKARKGFWQQLLDSKLISERKENNLTKAERGGLDERDKVGFIRRQLVETRQITKHVAQ<br>ILDARFNTEVNDKKQIRTVKIVTLKSNLVSNFRKEFRLYKVREINDYHHAHDAYLNAVVAKAILK<br>KYPKLEPEFVYGDYQKYDVKRYISRSKDPKDVEKATEKYFFYSNLLNFFKEEVHYADGTIIKRENIE<br>YSKDTGEVAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 158 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKAYHEKF<br>PTIYHLRKYLADSTKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDGFADLFLVAKKLYDAILLSGILTVTDPSTKAPLSASMIERYENHQKDLAT<br>LKQFIKSNLSEKYDEVFSDQSKDGYAGYIDGKTTQEAFYKYIKNLLSKLEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEIVDQASSAEDFINKMTNYDLYLPEEKVLPKHSLLYETFAVYNELTKVKFIAEGMR<br>DYQFLDSGQKKQIVNQLFKEKRKVTEKDIIQFLHNVDGYDGIELKGIEKQFNASLSTYHDLLKIIKD<br>KDFMDDPKNEEILENIIHTLTIFEDREMIKQRLAQYDSLFDEKVIKALTRRHYTGWGKLSAKLINGI<br>YDKQSKKTILDYLIDDGEINRNFMQLINDDGLSFKEIIQKAQVVGKTNDVKQVVQELPGSPAIKKGI<br>LQSIKLVDELVKVMGHAPESIVIEMARENQTTARGKKNSQQRYKRIEDALKNLAPGLDSNILKEHP<br>TDNVQLQNDRLFLYYLQNGKDMYTGEALDINQLSNYDIDHIVPQAFIKDDSLDNRVLTSSKDNRG<br>KSDNVPSLEVVQKRKAFWQQLLDSKLISQRKFDNLTKAERGGLTEHDKAGFIKRQLVETRQITKH<br>VAQILDARFNTEVDSKGKRIRKVKIITLKSNLVSNFRKEFGLYKVREINDYHHAHDAYLNAVVAKA<br>ILKKYPKLEPEFVYGDYQKYDLKRYISRSKDPKDVEKATQKYFFYSNLLNFFKEEVHYADGTIIKRE<br>NIEYSKDTGEIAWNKEKDFATVRKVLSCPQVNIVKKTEVQTGGFSKESILPKRNSDKLIARKKDW<br>PKKYGGFDSPTVAYSVLVVAKVEKGKSKKLKSVKELLGITIMERSSFEKNPIDFLEAKGYKEVRKD<br>LIVKLPKYSLFELENGRKRMLASAGELQKGNELALPSKYVNFLYLASHYEKLKGSPEDNEQKQLFV<br>EQHKHYLDEIIEQISEFSKRVILADANLDKVLSAYNKHRDKPIREQAENIIHLFTLTNLGAPAAFKYF<br>DTTIDRKRYTSTKEVLDATFIHQSITGLYETRIDLSQLGGD |
| 159 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAEIDESFFQRLDDSFLVPDDKRDSKYPIFGNLVKEKTYHDEFP<br>TIYHLRKYLADSSKKADLRLVYLALAHMIKYRGHFLIEGDFNSRNNDIKKNFQEFLDSYNAIFESDL<br>SLENSKQLEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLAAL<br>KQFIQNNLQEKYDEVFSDQSKDGYAGYIDGKTTQEAFYKYIKNILTKVEGADYFLEKIREDFLRK<br>QRTFDNGTIPYQVHLQEMKAILHNQGEYYPFLKENREKIQQILTFRIPYYVGPLARGNRDFAWLTR<br>NSDQAIRPWNFEEIVDQASSAEDFINKMTNYDLYLPEEKVLPKHSLLYETFAVYNELTKVKFIAEGL<br>RDYQFLDSGQKKQIVNQLFKEKRKVTEKDIIHYLHNVDGYDGIELKGIEKQFNASLSTYHDLLKIIK<br>DKEFMDDPKNEEILENIVHTLTIFEDREMIKQRLAQYDSLFDEKVIKALTRRHYTGWGKLSAKLING<br>IYDKQSKKTILDYLIDDDKINRNFMQLINDDGLSFKDIIQKAQVVGKTDDVKQVVQELPGSPAIKKG<br>ILQSIKLVDELVKVMGHAPESIVIEMARENQTTARGKKNSQQRYKRIEDALKNLAPGLDGNILKEY |

| SEQ ID NO | Nuclease Sequence |
|---|---|
| | PTDNIQLQNDRLFLYYLQNGRDMYTGEPLDINQLSSYDIDHIVPQAFIKDDSLDNRVLTSSKDNRGK
SDNVPSLEVVQKRKAFWQQLLDSKLISERKENNLTKAERGGLDERDKVGFIRRQLVETRQITKHVA
QILDARFNAEVNDKKQRIRKVKIITLKSNLVSNFRKEFGLYKVREINDYHHAHDAYLNAVVAKAIL
KKYPKLEPEFVYGDYQKYDLKRYISRSKDPKEIEKATQKYFFYSNLLNFFKEEVHYADGTIVKRENI
EYSKDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE
QHKHYLDEIIEQISEFSKRVILADANLDKVLSAYNKHRDKPIREQAENIIHLFTLTNLGAPAAFKYFD
TTIDRKRYTSTKEVLDATFIHQSITGLYETRIDLSQLGGD |
| 160 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKTYHDEFP
TIYHLRKYLADSQKKADLRLVYLALALAMIKYRGHFLIEGDENSKNNDIKKNFQEFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLA
ALKQFIQNNLQEKYDEVFSDQSKNGYAGYIDKTTQEEFYKYLKKILTGLEGADYFLEKIKREDLL
RKQRTFDNGTIPYQVHLAEMRAIIHRQGEHYPPFLKENKEKIEKILTFRIPYYVGPLARGNRDFAWLT
RNSDQAIRPWNFEEVVDKASSAEDFINKMTNYDLYLPEEKVLPKHSLLYETFAVYNELTKVKFIAE
GLRDYQFLDSGQKKQIVNQLFKEKRKVTEKDIIHYLHNVDGYDGIELKGIEKQFNASLSTYHDLLKI
IKDKEFMDDAKNEEILENIVHTLTIFEDREMIKQRLAQYDSLFDEKVIKALTRRHYTGWGKLSAKLI
NGISDKQTGKTILDYLIDDGKINRNFMQLIHDDGLSFKEIIQKAQVVGKTDDLKQVVQELPGSPAIK
KGILQSIKIVDELVKVMGHAPESIVIEMARENQTTNQGRRNSQQRYKKIEDAIKNLDSNLNSKILKE
YPTDNQALQNERLFLYYLQNGKDMYTGEALDINQLSNYDIDHIVPQAFIKDDSLDNRVLTSSKDNR
GKSDNVPSIEIVQKRKAFWQQLLDSKLISERKENNLTKAERGGLDERDKVGFIKRQLVETRQITKH
VAQILDARFNTEVDENNQKIRTVKIITLKSNLVSNFRKEFGLYKVREINDYHHAHDAYLNAVVAKA
ILKKYPKLEPEFVYGDYQKYDLKRYISRSKDPKDIEKATEKYFFYSNLLNFFKEEVHYADGTIIKRG
NVEYSKDTGEIAWNKEKDFATVRKVLSCPQVNIVKKTEVQTGGFSKESILPKRNSDKLIARKKDW
DPKKYGGFDSPTVAYSVLVVAKVEKGKSKKLKSVKELLGITIMERSSFEKNPIDFLEAKGYKEVRK
DLIVKLPKYSLFELENGRKRMLASAGELQKGNELALPSKYVNFLYLASHYEKLKGSPEDNEQKQLF
VEQHKHYLDEIIEQISEFSKRVILADANLDKVLSAYNKHRDKPIREQAENIIHLFTLTNLGAPAAFKY
FDTTIDRKRYTSTKEVLDATFIHQSITGLYETRIDLSQLGGD |
| 161 | MTKPYSIGLDIGTNSVGWAVITDSYKVPSKKMKVLGNTSKKYVKKNLLGALLFESGITAEGRRLK
RTARRRYTRRRNRILYLQEIFATEMAKIDESFFQRLDDSFLVPDDKRDSKYPIFGNLVEEKTYHDEF
PTIYHLRKYLADSQKKADLRLVYLALALAHMIKYRGHFLIEGDFNSRNNDIKKNFQEFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLA
ALKQFIQNNLQEKYDEVFSDQSKDGYAGYIDKTTQEAFYKYIKNLLSKFEGADYFLDKIEREDFL
RKQRTFDNGSIPHQIHLQEMNAILRRQGEHYPPFLKENKEKIEKILTFRIPYYVGPLARGNRDFAWLT
RNSDQAIRPWNFEEVVDKASSAEDFINKMTNYDLYLPEEKVLPKHSLLYETFAVYNELTKVKFIAE
GLRDYQFLDSGQKKQIVNQLFKEKRKVTEKDIIHFLHNVDGYDGIELKGIEKQFNASLSTYHDLLKI
IKDKEFMDDPKNEEILENIVHTLTIFEDREMIKQRLAQYDSLFDEKVIKALTRRHYTGWGKLSAKLI
NGIRDKQTNKTILDYLIDDDKINRNFMQLIHDDGLSFKEIIQKAQVVGDTDDLRQVVQNLPGSPAIK
KGILQSIKIVDELVKVMGHAPEQIVIEMARENQTTNQGRRNSQQRYKLIEDGVKNLASDLNGNILK
EYPTDNQALQNDRLFLYYLQNGKDMYTGEELDINQLSNYDIDHIVPQAFIKDDSLDNRVLTSSKDN
RGKSDNVPSIEVVQKRKAFWQQLLDSKLISERKENNLTKAERGGLDERDKVGFIRRQLVETRQITK
HVAQILDARFNTEVDENGKRIRKVKIITLKSNLVSNFRKEFGLYKVREINDYHHAHDAYLNAVVAK
AILKKYPKLEPEFVYGDYQKYDISRYISRSKVSDSIDKATAKYFFYSNLLNFFKEKVRYSNGTIIVRP
VIEYSKDTGEIAWNKEKDFATVRKVLSCPQVNIVKKTEVQTGGFSKESILPKRNSDKLIARKKDWD
PKKYGGFDSPTVAYSVLVVAKVEKGKSKKLKSVKELLGITIMERSSFEKNPIDFLEAKGYKEVRKD
LIVKLPKYSLFELENGRKRMLASAGELQKGNELALPSKYVNFLYLASHYEKLKGSPEDNEQKQLFV
EQHKHYLDEIIEQISEFSKRVILADANLDKVLSAYNKHRDKPIREQAENIIHLFTLTNLGAPAAFKYF
DTTIDRKRYTSTKEVLDATFIHQSITGLYETRIDLSQLGGD |
| 162 | MTKPYSIGLDIGTNSVGWAVITDSYKVPSKKMKVLGNTSKKYVKKNLLGALLFESGITAEGRRLK
RTARRRYTRRRNRILYLQEIFSTEMSEIDESFFQRLDDSFLVPDDKRDSKYPIFGNLVEEKTYHDEFP
TIYHLRKYLADSQKKADLRLVYLALALAHMIKYRGHFLIEGDFNSKNNDIKKNFQDFLDSYNAIFESD
LSLENSEQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLSA
LKQFIKRNLSEKYDEVFSDESKDGYAGYINGKTTQEAFYKYIKNLLSKLEGADYFLEKIEREDFLRK
QRTFDNGSIPHQIHLQEMNAIIRRQGEHYPPFLKENKEKIQQILTFRIPYYVGPLARGNRDFAWLTRNS
DQAIRPWNFEEIVDKASSAEDFINKMTNYDLYLPEEKVLPKHSLLYETFAVYNELTKVKFIAEGLR
DYQFLDSGQKKQIVNQLFKEKRKVTEKDIIHYLHNVDGYDGIELKGIEKQFNASLSTYHDLLKIIKD
KEFMDDPKNEEILENIVHTLTIFEDREMIKQRLAQYDSLFDEKVIKALTRRHYTGWGKLSAKLINGI
CDKKTGNTILDYLIDDDKINRNFMQLINDDGLSFKEIIQKAQVVGKTDDVKQVVQELPGSPAIKKGI
LQSIKIVDELVKVMGHEPESIVIEMARENQTTARGKKNSQQRYKRIEDALKNLAPGLDSNILKEHPT
DNIQLQNDRLFLYYLQNGKDMYTGEELDIHHLSDYDIDHIVPQAFIKDDSIDNRVLTSSKDNRGKS
DNVPSIEVVQKRKAFWQQLLDSKLISEHKFNNLTKAERGGLDERDKVGFIRRQLVETRQITKHVAQ
ILDARFNTEVNEKGQKIRKVKIVTLKSNLVSNFRKEFELYKVREINDYHHAHDAYLNAVVAKAILK
KYPKLEPEFVYGDYQKYDVKRYISRSKDPRDLHKATEKYFFYSNLLNFFKEEVHYADGTIVRRNV
EYSNDTGEIAWNKEKDFATVRKVLSCPQVNIVKKTEVQTGGFSKESILPKRNSDKLIARKKDWDPK
KYGGFDSPTVAYSVLVVAKVEKGKSKKLKSVKELLGITIMERSSFEKNPIDFLEAKGYKEVRKDLI
VKLPKYSLFELENGRKRMLASAGELQKGNELALPSKYVNFLYLASHYEKLKGSPEDNEQKQLFVE |

| SEQ ID NO | Nuclease Sequence |
|---|---|
| | QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 163 | MTKPYSIGLDIGTNSVGWAVITDSYKVPSKKMKVLGNTSKKYVKKNLLGALLFESGITAEGRRLK<br>RTARRRYTRRRNRILYLQEIFSTEMSKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQQFLDSYNSLYESD<br>FSLENNAQVEEIVKDKISKSAKRERVLKLFPDEKSTGLFSEFLKLIVGNQADFKKHFDLEEKAPLQF<br>SKDTYDEDLENLLGQIGDDFADLFLVAKKLYDAILLSGILTVTDPSTKAPLSASMIERYENHQKDLA<br>ALKQFIKNNIPEKYDEVFADQSKDGYAGYIDGKTTQEAFYKYVKEKLNNLKGADYFLDKIEREDF<br>LRKQRTFDNGSIPHQIHLQEMNAIIRRQGEHYPFLKENKEKIEKILTFRIPYYVGPLARGNRDFAWLT<br>RNSDQAIRPWNFEEIVDQASSAEEFINKMTNYDLYLPEEKVLPKHSLLYETFAVYNELTKVKFIAEG<br>LRDYQFLDSGQKKQIVNQLFKEKRKVTEKDIIQFLHNVDGYDGIELKGIEKQFNASLSTYHDLLKII<br>KDKEFMDDPKNEEILENIVHTLTIFEDREMIKQRLAQYDSLFDEKVIKALTRRHYTGWGKLSAKLIN<br>GICDKKTGKTILDYLIDDDKINRNFMQLINDDGLSFKDIIQKAQVVGKTDDVKQVVQELPGSPAIKK<br>GILQSIKIVDELVKVMGHAPESIVIEMARENQTTARGKKNSQQRYKRIEDALKNLAPGLDSNILKEH<br>PTDNTALQNDRLFLYYLQNGRDMYTGNPLDINQLSSYDIDHIVPQAFIKDDSLDNRVLTSSKDNRG<br>KSDNVPSLEVVQKRKAFWQQLLDSKLISERKENNLTKAERGGLDERDKVGFIKRQLVETRQITKHV<br>AQILDARFNTEVDENNQKIRKVKIVTLKSNLVSNFRKEFGLYKVREINDYHHAHDAYLNAVVAKA<br>ILKKYPKLEPEFVYGDYQKYDIKRYISRSKDPKEIEKATEKYFFYSNLLNFFKEEVHYADGTIVKRE<br>NIEYSKDTGEIAWNKEKDFATVRKVLSCPQVNIVKKTEVQTGGFSKESILPKRNSDKLIARKKDWD<br>PKKYGGFDSPTVAYSVLVVAKVEKGKSKKLKSVKELLGITIMERSSFEKNPIDFLEAKGYKEVRKD<br>LIVKLPKYSLFELENGRKRMLASAGELQKGNELALPSKYVNFLYLASHYEKLKGSPEDNEQKQLFV<br>EQHKHYLDEIIEQISEFSKRVILADANLDKVLSAYNKHRDKPIREQAENIIHLFTLTNLGAPAAFKYF<br>DTTIDRKRYTSTKEVLDATFIHQSITGLYETRIDLSQLGGD |
| 164 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSQKKADLRLVYLALAHMIKYRGHFLIEGDFNSRNNDIKKNFQDFLDSYNAIFESD<br>LSLENSKQLEEIVKDKISKSAKRERVLKLFPDEKSTGLFSEFLKLIVGNQADFKKHFNLEEKAPLHFS<br>KDTYDEDLENLLGQIGDDFADLFLVAKKLYDAILLSGILTVTDPSTKAPLSASMIERYENHQKDLA<br>ALKQFIQNNLPEKYDEVFSDQSKDGYAGYIDGKTTQEAFYKYIKNLLSKFEGADYFLEKIEREDFL<br>RKQRTFDNGSIPYQIHLQEMRAILSRQGEYYPFLKDNKEKIEKILTFRIPYYVGPLARGNRDFAWLT<br>RNSDQAIRPWNFEEIVDQASSAEDFINKMTNYDLYLPEEKVLPKHSLLYETFAVYNELTKVKFIAEG<br>LRDYQFLDSGQKKQIVNQLFKDKRKVTEKDIIHYLHNVDGYDGIELKGIEKQFNASLSTYHDLLKII<br>KDKEFMDDPKNEEILENIVHTLTIFEDREMIKQRLAQYDSLFDEKVIKALTRRHYTGWGKLSAKLIN<br>GIRDKKSGKTILDYLIDDDKINRNFMQLINDDGLSFKDIIQKAQVVGKTDDVKQVVQELPGSPAIKK<br>GILQSIKIVDELVKVMGHAPESIVIEMARENQTTARGKKNSQQRYKRIEDALKNLAPGLDSNILKEH<br>PTDNIQLQNDRLFLYYLQNGKDMYTGNPLDINQLSSYDIDHIVPQAFIKDDSLDNRVLTSSKDNRG<br>KSDNVPSLEVVQKRKAFWQQLLDSKLISERKYNNLTKAERERDGLNELDKVGFIKRQLVETRQITK<br>HVAQILDARFNTEVNEKNQKIRKVKIITLKSNLVSNFRKEFGLYKVREINDYHHAHDAYLNAVVA<br>KAILKKYPKLEPEFVYGDYQKYDLKRYISRSKDPKDIEKATEKYFFYSNLLNFFKEEVHYADGTIIK<br>RENIEYSNDTGEIAWNKEKDFATVRKVLSCPQVNIVKKTEVQTGGFSKESILPKRNSDKLIARKKD<br>WDPKKYGGFDSPTVAYSVLVVAKVEKGKSKKLKSVKELLGITIMERSSFEKNPIDFLEAKGYKEVR<br>KDLIVKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDATFIHQSITGLYETRIDLSQLGGD |
| 165 | MTKPYSIGLDIGTNSVGWAVITDSYKVPSKKMKVLGNTSKKYVKKNLLGALLFESGITAEGRRLK<br>RTARRRYTRRRNRILYLQEIFATEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQEFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLAT<br>LKQFIKNNLSEKYDEVFSDQSKDGYAGYIDGKTTQEAFYKYIKNTLSKIEGADYFLDKIEREDFLRK<br>QRTFDNGSIPHQIHLQEMHAIIHRQGEYYPFLQENKEKIEKILTFRIPYYVGPLARGNRDFAWLTRNS<br>DQAIRPWNFEEIVDKASSAEDFINKMTNYDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLSTYHDLLKIIKD<br>KEFMDDPKNEEILENIVHTLTIFEDREMIKQRLAQYDTLFDEKVIKALTRRHYTGWGKLSAKLINGI<br>RDKQSQKTILDYLIDDDKINRNFMQLINDDGLSFKDIIQKAQVVGKTDDVKQVVQELPGSPAIKKGI<br>LQSIKIVDELVKVMGHAPESIVIEMARENQTTARGKKNSQQRYKRIEDALKNLAPGLDSNILKENPT<br>DNIQLQNDRLFLYYLQNGKDMYTGEELDINQLSNYDIDHIVPQAFIKDDSLDNRVLTSSKDNRGKS<br>DNVPSIEVVQKRKAFWQQLLDSKLISERKENNLTKAERGGLDERDKVGFIKRQLVETRQITKHVAQ<br>ILDARFNTEVNDKNQKIRTVKIITLKSNLVSNFRKEFRLYKVREINDYHHAHDAYLNAVVAKAILK<br>KYPKLEPEFVYGDYHHYDLKRQISKSKISKSIDKATQKYFFYSNLLNFFKEEVHYADGTIIKRENIEY<br>SKDTGEIAWNKEKDFATVRKVLSCPQVNIVKKTEVQTGGFSKESILPKRNSDKLIARKKDWDPKK<br>YGGFDSPTVAYSVLVVAKVEKGKSKKLKSVKELLGITIMERSSFEKNPIDFLEAKGYKEVRKDLIV<br>KLPKYSLFELENGRKRMLASAGELQKGNELALPSKYVNFLYLASHYEKLKGSPEDNEQKQLFVEQ<br>HKHYLDEIIEQISEFSKRVILADANLDKVLSAYNKHRDKPIREQAENIIHLFTLTNLGAPAAFKYFDT<br>TIDRKRYTSTKEVLDATFIHQSITGLYETRIDLSQLGGD |
| 166 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQNFLDSYNAIFESDL<br>SLENSKQLEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLAAL |

| SEQ ID NO | Nuclease Sequence |
|---|---|
| | KQFIQNNLQEKYDEVFSDQSKDGYAGYIDGKTTQEAFYKYIKNLLAKFEGADYFLEKIEREDFLRK<br>QRTFDNGSIPYQIHLQEMQAIIHRQGEYYPFLKENKEKIEKILTFRIPYYVGPLARGNRDFAWLTRNS<br>DQAIRPWNFEEIVDQASSAEEFINKMTNYDLYLPEEKVLPKHSLLYETFAVYNELTKVKFIAEGLRD<br>YQFLDSGQKQIVNQLFKEKRKVTEKDIIHYLHNVDGYDGIELKGIEKQFNASLSTYHDLLKIIKDK<br>AFMDDAKNEAILENIIHTLTIFEDREMIKQRLAQYDSLFDEKVIKALTRRHYTGWGKLSAKLINGIC<br>DKQTGDTILDYLIDDDKINRNFMQLINDDGLSFKEIIQKAQVVGKTDDVKQVVQELPGSPAIKKGIL<br>QSIKIVDELVKVMGYEPEQIVIEMARENQTTNQGRRNSQQRYKLLEDGVKNLAKDLDGNILKEYPT<br>DNQALQNDRLFLYYLQNGKDMYTGEPLDINQLSSYDIDHIIPQAFIKDDSLDNRVLTSSKDNRGKS<br>DNVPSIEVVQKRKAFWQQLLDSKLISERKENNLTKAERGGLDERDKVGFIKRQLVETRQITKHVAQ<br>ILDARFNVEVNDKKQIRTVKIITLKSNLVSNFRKEFGLYKVREINDYHHAHDAYLNAVVAKAILK<br>KYPKLEPEFVYGDYQKYDLKRYISRSKDPKDVEKATQKYFFYSNLLNFFKEEVHYADGTIIKRENIE<br>YSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 167 | MTKPYSIGLDIGTNSVGWAVITDNYKVPSKKMKVLGNTSKKYVKKNLLGALLFESGITAEGRRLK<br>RTARRRYTRRRNRILYLQEIFATEMNKIDESFFQRLDDSFLVPDDKRDSKYPIFGNLVEEKTYHDEF<br>PTIYHLRKYLADSSKKADLRLVYLALAHMIKYRGHFLIEGDFNSRNNDIKKNFQDFLDSYNAIFESD<br>LSLENSKQLEEIVDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIQNNLQEKYDEVFSDQSKDGYAGYIDGKTTQEAFYKYIKNLLSKFEGADYFLEKIEREDFL<br>RKQRTFDNGSIPHQIHLQEMNAIIRRQGEYYPFLQENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEGL<br>RDYQFLDSGQKKQIVNQLFKEKRKVTEKDIIHFLHNVDGYDGIELKGIEKQFNASLSTYHDLLKIIK<br>DKEFMDDPKNEEILENIVHTLTIFEDREMIKQRLAQYDSLFDEKVIKALTRRHYTGWGKLSAKLING<br>IRDKQSQKTILDYLIDDDQINRNFMQLINDDGLSFKEIIQKAQVVGKTDDLRQVVQNLPGSPAIKKG<br>ILQSIKIVDELVKVMGKDPESIVIEMARENQTTARGKKNSQQRYKRIEDALKNLAPGLDSNILKEHP<br>TDNIQLQNDRLYLYYLQNGKDMYTGNPLDINQLSNYDIDHIVPQAFIKDDSIDNRVLTSSKDNRGK<br>SDNVPSIEIVQKRKAFWQQLLDSKLISERKENNLTKAERGGLDEKDKVGFIRRQLVETRQITKHVA<br>QILDARFNTELDENGKRIRKVKIVTLKSNLVSNFRKEFGLYKVREINDYHHAHDAYLNAVVAKAIL<br>KKYPKLEPEFVYGDYQKYDVKRYISRSKNPKEIDKATEKYFFYSNLLNFFKEEVHYADGTIVKREN<br>IEYSKDTGEIAWNKEKDFATVRKVLSCPQVNIVKKTEVQTGGFSKESILPKRNSDKLIARKKDWDP<br>KKYGGFDSPTVAYSVLVVAKVEKGKSKKLKSVKELLGITIMERSSFEKNPIDFLEAKGYKEVRKDL<br>IVKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 168 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQDFLDSYNAIFESD<br>LSLENSKQLEEIVDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIKGNLSEKYDEVFSDQSKDGYAGYIDGKTTQEAFYKYIKNLLSKLEGADYFLDKIEREDFL<br>RKQRTFDNGSIPHQIHLQEMNAIIRRQGEHYPPFLKENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEGL<br>RDYQFLDSGQKKQIVNQLFKEKRKVTEKDIIHFLHNVDGYDGIELKGIEKQFNASLSTYHDLLKIIK<br>DKEFMDDPKNEEILENIVHTLTIFEDREMIKQRLAQYDSLFDEKVIKALTRRHYTGWGKLSAKLING<br>ICDKQTGDTILDFLIDDDKINRNFMQLINDDGLSFKEIIQKAQVVGKTDDLKQVVQELPGSPAIKKGI<br>LQSIKIVDELVKVMGHAPEQIVIEMARENQTTNQGRRNSRQRYKLIEDGVKNLASDLNGNILKEYP<br>TDNQALQNDRLFLYYLQNGKDMYTGEELDINQLSNYDIDHIVPQAFIKDDSLDNRVLTSSKDNRG<br>KSDNVPSLEIVQKRKGFWQQLLDSKLISERKENNLTKAERGGLDERDKVGFIKRQLVETRQITKHV<br>AQILDSRFNTEVDEKGKKIRDVKIITLKSNLVSNFRKEFGLYKVREINDYHHAHDAYLNAVVAKAI<br>LKKYPKLEPEFVYGDYQKYDIKRYISRSKDPKDVEKATEKYFFYSNLLNFFKEEVHYADGTIVKRE<br>NIEYSKDTGEIAWNKEKDFATVRKVLSCPQVNIVKKTEVQTGGFSKESILPKRNSDKLIARKKDWD<br>PKKYGGFDSPTVAYSVLVVAKVEGKSKKLKSVKELLGITIMERSSFEKNPIDFLEAKGYKEVRKD<br>LIVKLPKYSLFELENGRKRMLASAGELQKGNELALPSKYVNFLYLASHYEKLKGSPEDNEQKQLFV<br>EQHKHYLDEIIEQISEFSKRVILADANLDKVLSAYNKHRDKPIREQAENIIHLFTLTNLGAPAAFKYF<br>DTTIDRKRYTSTKEVLDATFIHQSITGLYETRIDLSQLGGD |
| 169 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQNFLDSYNAIFESDL<br>SLENNAQVEEIVDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIKNNLPEKYDEVFSDESKDGYAGYINGKTTQEAFYKYIKNLLSKLEGADYFLDKIEREDFL<br>RKQRTFDNGSIPHQIHLQEMNAIIRRQGEHYPPFLKENKEKIEKILTFRIPYYVGPLARGNRDFAWLTR<br>NSDQAIRPWNFEEVVDKASSAEDFINKMTNYDLYLPEEKVLPKHSLLYETFAVYNELTKVKFIAEG<br>LRDYQFLDSGQKKQIVNQLFKDKRKVTEKDIIHYLHNVDGYDGIELKGIEKQFNASLSTYHDLLKII<br>KDKEFMDDPKNEEILENIVHTLTIFEDREMIKQRLAQYDSLFDEKVIKALTRRHYTGWGKLSAKLIN<br>GISDKQTGNTILDYLIDDDKINRNFMQLINDDGLSFKEIIQKAQVVGESDNLKQVVQNLPGSPAIKK<br>GILQSIKIVDELVKVMGKDPEHIVVEMARENQFTNQGRRNSQQRYKKIMDAIKNLDSNLNSKILKE<br>YPTNNQALQNDRLFLYYLQNGKDMYTGEPLDINQLSNYDIDHIIPQAFIKDDSLDNRVLTSSKDNR |

| SEQ ID NO | Nuclease Sequence |
|---|---|
| | GKSDNVPSLEVVEKMKAFWQQLLDSKLISERKYNNLTKAERERGGLNELDKVGFIKRQLVETRQI<br>TKHVAQILDARFNTEVNEKGKKIRKVKIITLKSNLVSNFRKEFGLYKVREINDYHHAHDAYLNAVV<br>AKAILKKYPKLEPEFVYGDYQKYDIKRYISRSKDPKDIEKATEKYFFYSNLLNFFKEEVHYADGTIV<br>KRENIEYSKDTGEIAWNKEKDFATVRKVLSCPQVNIVKKTEVQTGGFSKESILPKRNSDLIARKK<br>DWDPKKYGGFDSPTVAYSVLVVAKVEKGKSKKLKSVKELLGITIMERSSFEKNPIDFLEAKGYKEV<br>RKDLIVKLPKYSLFELENGRKRMLASAGELQKGNELALPSKYVNFLYLASHYEKLKGSPEDNEQK<br>QLFVEQHKHYLDEIIEQISEFSKRVILADANLDKVLSAYNKHRDKPIREQAENIIHLFTLTNLGAPAA<br>FKYFDTTIDRKRYTSTKEVLDATFIHQSITGLYETRIDLSQLGGD |
| 170 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSSKKADLRLVYLALAHMIKYRGHFLIEGDFNSRNNDIKKNFQDFLDSYNAIFESDL<br>SLENSKQLEEIVKDKISKSAKKDRLLKLFPGEKNSGIFSEFLKLIVGNQADFRKYFNLDEKASLHFSK<br>ESYDEDLETLLGHIGDDYSDVFLKAKKLYDAILLSGILTVTDNETEAPLSSAMIMRYKEHEEDLALL<br>KAYIRKISLETYNEVFKDDTKNGYAGYIDKTNQEDFYVYLKKLLTGLEGADYFLEKINREDLLRK<br>QRTFDNGKIPYQIHLQEMRAIIDKQAKFYPFLAKNKEKIEKILTFRIPYYVGPLARGNSDFAWSIRKR<br>NEKITPWNFEDVIDKESSAEAFINRMTSFDLYLPEEKVLPKHSLLYETFTVYNELTKVRFIAESMRD<br>YQFLDSKQKKDIVRLYFPKGKRKVTDKDIIDYLHAIDGYDGIELKGIEKQFNSSLATYHDLLNIINDK<br>EFLDDSSNEAIIEEIIHTLTIFEDREMIKQRLSKFENIFDKSVLKKLSRRHYTGWGKLSAKLINGIRDE<br>KSGKTILDYLIDDGVSNRNFMQLIHDDTLSFKKKIQKAQIIGDQDNIKQVVQSLPGSPAIKKGILQSI<br>KIVDELVKVMGREPESIVVEMARENQYTNQGKSNSQQRLKRLEESLKDLGSKILKENVPAKLSKID<br>NNALQNERLYLYYLQNGKDMYTGQDLDIDRLSNYDIDHIIPQAFLKDNSIDNKVLVSSASNRGKSD<br>DVPSLEVVRQRKTFWHQLLKSKLISQRKFDNLTKAERGGLTEDDKAGFIKRQLVETRQITKHVAQI<br>LDSRFNTERDDNDKVIRNVKIITLKSNLVSQFRKDFQLYKVREINDYHHAHDAYLNAVVATAILKK<br>YPKLEPEFVYGDYKKYDVRKLISKSDQSMGKATAKMFFYSNLMNFFKKKVRLSDGTVIVRPVIEY<br>SKDTGEIAWNKEKDFATVRKVLSCPQVNIVKKTEVQTGGFSKESILPKRNSDKLIARKKDWDPKK<br>YGGFDSPTVAYSVLVVAKVEKGKSKKLKSVKELLGITIMERSSFEKNPIDFLEAKGYKEVRKDLIV<br>KLPKYSLFELENGRKRMLASAGELQKGNELALPSKYVNFLYLASHYEKLKGSPEDNEQKQLFVEQ<br>HKHYLDEIIEQISEFSKRVILADANLDKVLSAYNKHRDKPIREQAENIIHLFTLTNLGAPAAFKYFDT<br>TIDRKRYTSTKEVLDATFIHQSITGLYETRIDLSQLGGD |
| 171 | MTKPYSIGLDIGTNSVGWAVITDSYKVPSKKMKVLGNTSKKYVKKNLLGALLFESGITAEGRRLK<br>RTARRRYTRRRNRILYLQEIFATEMAKIDESFFQRLDDSFLVPDDKRDSKYPIFGNLVEEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFPDLEEKAPLQFS<br>KDTYDEDLENLLGQIGDGFADLFLVAKKLYDAILLSGILTVTDPSTKAPLSASMIERYENHQKDLA<br>ALKQFIQNNLQEKYDEVFSDQSKDGYAGYIDKTTQEAFYKYIKNLLSKLEGADYFLDKIEREDFL<br>RKQRTFDNGSIPHQIHLQEMNAILRRQGEHYPFLKENKEKIEKILTFRIPYYVGPLARGNRDFAWLT<br>RNSDQAIRPWNFEEIVDQASSAEDFINKMTNYDLYLPEEKVLPKHSLLYETFAVYNELTKVKFIAEG<br>LRDYQFLDSGQKKQIVNQLFKEKRKVTEKDIIQYLHNVDGYDGIELKGIEKQFNASLSTYHDLLKII<br>KDKEFMDDPKNEEILENIVHTLTIFEDREMIKQRLAQYDSLFDEKVIKALSRRHYTGWGRLSAKLIN<br>GIHDKQSRKTILDYLIDDDKINRNFMQLINDDGLSFKEIIQKAQVVQKTDDLKQVVQNLPGSPAIKK<br>GILQSIKIVDELVKVMGREPESIVVEMARENQFTNQGRRNSQQRYKKIKDAIKNLDSNLNSKILKEY<br>PTNNQALQNDRLFLYYLQNGKDMYTGEALDINQLSNYDIDHIIPQAFIKDDSLDNRVLTSSKDNRG<br>KSDNVPSIEIVEKMKGFWQQLLDSKLISERKFNNLTKAERGGLDERDKVGFIRRQLVETRQITKHV<br>AQILDARFNTEVNDKKQRIRKVKIVTLKSNLVSNFRKEFGLYKVREINDYHHAHDAYLNAVVAKA<br>ILKKYPKLEPEFVYGDYQKYDLKRYISSSNPSKEIDKATEKYFFYSNLLNFFKEEVHYADGTIVKRE<br>NIEYSKDTGEIAWNKEKDFATVRKVLSCPQVNIVKKTEVQTGGFSKESILPKRNSDKLIARKKDWD<br>PKKYGGFDSPTVAYSVLVVAKVEKGKSKKLKSVKELLGITIMERSSFEKNPIDFLEAKGYKEVRKD<br>LIVKLPKYSLFELENGRKRMLASAGELQKGNELALPSKYVNFLYLASHYEKLKGSPEDNEQKQLFV<br>EQHKHYLDEIIEQISEFSKRVILADANLDKVLSAYNKHRDKPIREQAENIIHLFTLTNLGAPAAFKYF<br>DTTIDRKRYTSTKEVLDATFIHQSITGLYETRIDLSQLGGD |
| 172 | MNKPYSIGLDIGTNSVGWAVITDNYKVPSKKMKVLGNTSKKYVKKNLLGALLFESGITAEGRRLK<br>RTARRRYTRRRNRILYLQEIFATEMAKIDESFFQRLDDSFLVPDDKRDSKYPIFGNLAQEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFPDLEEKAPLQFS<br>KDTYDEDLENLLGQIGDGFADLFLVAKKLYDAILLSGILTVTDPSTKAPLSASMIERYENHQKDLA<br>ALKQFIQNNLQEKYDEVFSDQSKDGYAGYIDKTTQEAFYKYIKNLISKIEGADYFLEKIEREDFLR<br>KQRTFDNGSIPHQIHLQEMNAILHNQGDYYPFLKENKEKIQQILTFRIPYYVGPLARGNRDFAWLTR<br>NSDQAIRPWNFEEIVDKASSAEDFINKMTNYDLYLPEEKVLPKHSLLYETFAVYNELTKVKFIAEGL<br>RDYQFLDSGQKKQIVNQLFKEKRKVTEKDIIQYLHNVDGYDGIELKGIEKQFNASLSTYHDLLKIIK<br>DKEFMDDPKNEEILENIIHTLTIFEDREMIKQRLAQYDSLFDEKVIKALTRRHYTGWGKLSAKLINGI<br>RDKQSNKTILDYLIDDDKINRNFMQLINDDGLSFKEIIQKAQVVGKTDDVKQVVQELPGSPAIKKGI<br>LQSIKLVDELVKVMGSDPESIVIEMARENQTTNQGRRNSQQRYKKIEEAIKNLDSNLNSKILKEYPT<br>DNNQALQNDRLFLYYLQNGKDMYTGEELDINQLSNYDIDHIVPQAFIKDDSLDNRVLTSSKDNRGK<br>SDNVPSIEVVQRKRKGFWQQLLDSKLISERKENNLTKAERGGLDERDKVGFIKRQLVETRQITKHVA<br>QILDARFNTEVNENNQKIRKVKIITLKSNLVSNFRKEFGLYKVREINDYHHAHDAYLNAVVAKAIL<br>KKYPKLEPEFVYGDYQKYDVKRYISRSKDPKEIEKATEKYFFYSNLLNFFKEEVHYADGTIIKRENI<br>EYSNDTGEIAWNKEKDFATVRKVLSCPQVNIVKKTEVQTGGFSKESILPKRNSDKLIARKKDWPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |

| SEQ ID NO | Nuclease Sequence |
|---|---|
| 173 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVEEKVYHDEF
PTIYHLRKYLADSSKKADLRLVYLALAHMIKYRGHFLIEGDFNSRNNDIKKNFQEFLDSYNAIFESD
LSLENNAQVEEIVKDKISKSAKRERVLKLFPDEKSTGLFSEFLKLIVGNQADFKKHFDLEEKAPLQF
SKDTYDEDLENLLGQIGDDFADLFLVAKKLYDAILLSGILTVTDPSTKAPLSASMIERYENHQKDLA
QLKQFIKASLPEKYYDVFADESKNGYAGYIENGVKQDEFYKYLKNTLNKIEGSDYFLDKIEREDFL
RKQRTFDNGSIPHQIHLQEMNAIIRRQGEHYPFLQENKEKIEKILTFRIPYYVGPLARGNRDFAWLTR
NSDQAIRPWNFEEVVDKASSAEDFINKMTNYDLYLPEEKVLPKHSLLYETFAVYNELTKVKFIAEG
LRDYQFLDSGQKKQIVNQLFKEKRKVTEKDIIHYLHNVDGYDGIELKGIEKQFNASLSTYHDLLKII
KDKEFMDDPKNEEILENIVHTLTIFEDREMIKQRLAQYDSLFDEKVIKALTRRHYTGWGKLSAKLIN
GICDKQTGNTILDYLIDDDKINRNFMQLINDDGLSFKEIIQKAQVVGKTDDVKQVVQELPGSPAIKK
GILQSIKIVDELVKVMGHAPESIVIEMARENQTTARGKKNSQQRYKRIEDALKNLAPGLDSNILKEN
PTDNIQLQNDRLFLYYLQNGKDMYTGKELDINQLSNYDIDHIVPQAFIKDDSLDNRVLTSSKDNRG
KSDNVPSIEVVQKRKAFWQQLLDSKLISERKENNLTKAERGGLNELDKVGFIKRQLVETRQITKHV
AQILDARFNTEVDENNQRIRKVKIITLKSNLVSNFRKEFGLYKVREINDYHHAHDAYLNAVVAKAI
LKKYPKLEPEFVYGDYQKYDLKRYISRSKDPKDIEKATEKYFFYSNLLNFFKEEVHYADGTIVKRE
NIEYSKDTGEIAWNKEKDFATVRKVLSCPQVNIVKKTEVQTGGFSKESILPKRNSDKLIARKKDWD
PKKYGGFDSPTVAYSVLVVAKVEKGKSKKLKSVKELLGITIMERSSFEKNPIDFLEAKGYKEVRKD
LIVKLPKYSLFELENGRKRMLASAGELQKGNELALPSKYVNFLYLASHYEKLKGSPEDNEQKQLFV
EQHKHYLDEIIEQISEFSKRVILADANLDKVLSAYNKHRDKPIREQAENIIHLFTLTNLGAPAAFKYF
DTTIDRKRYTSTKEVLDATFIHQSITGLYETRIDLSQLGGD |
| 174 | MTKPYSIGLDIGTNSVGWAVITDSYKVPSKKMKVLGNTSKKYVKKNLLGALLFESGITAEGRRLK
RTARRRYTRRRNRILYLQEIFSTEMAKVDESFFQRLDDSFLVPDDKRDSKYPIFGNLVEEKTYHDEF
PTIYHLRKYLADSSKKADLRLVYLALAHMIKYRGHFLIEGDFNSRNNDIKKNFQNFLDSYNAIFESD
LSLENSEQLEEIVKDKISKSAKRERVLKLFPDEKSTGLFSEFLKLIVGNQAEFKKHFDLEEKAPLQFS
KDTYDEDLENLLGQIGDGFADLFLVAKKLYDAILLSGILTVTDPSTKAPLSASMIERYENHQKDLA
ALKQFIQNNLQEKYDEVFSDQSKDGYAGYIDGKTTQEAFYKYIKNLLSKFEGADYFLDKIEREDFL
RKQRTFDNGSIPHQIHLQEMNAILRRQGEHYPFLKENKEKIQQILTFRIPYYVGPLARGNRDFAWLT
RNSDQAIRPWNFEEVVDKASSAEDFINKMTNYDLYLPEEKVLPKHSLLYETFAVYNELTKVKFIAE
GLRDYQFLDSGQKKQIVNQLFKEKRKVTEKDIIHFLHNVDGYDGIELKGIEKQFNASLSTYHDLLKI
IKDKDFMDDPKNEEILENIVHTLTIFEDREMIKQRLAQYDSLFDEKVIKALTRRHYTGWGKLSAKLI
NGICDKQTGDTILDYLIDDDKINRNFMQLIHDDGLSFKEIIQKAQVFGKTNDVKQVVQELPGSPAIK
KGILQSIKIVDELVKVMGHAPESIVIEMARENQTTNQGRRNSQQRYKLIEDGVKNLASDLNGNILKE
YPTDNQALQNDRLFLYYLQNGKDMYTGNPLDINQLSNYDIDHIVPQAFIKDDSLDNRVLTSSKDNR
GKSDNVPSLEVVEKMKAFWQQLLDSKLISERKYNNLTKAERERGGLNELDKVGFIKRQLVETRQI
TKHVAQILDARFNTEVDENNQKIRKVKIITLKSNLVSNFRKEFGLYKVREINDYHHAHDAYLNAVV
AKAILKKYPKLEPEFVYGDYQKYDLKRYISRSKDPKEIEKATEKYFFYSNLLNFFKEEVHYADGTII
KRENIEYSKDTGEIAWNKEKDFATVRKVLSCPQVNIVKKTEVQTGGFSKESILPKRNSDKLIARKK
DWDPKKYGGFDSPTVAYSVLVVAKVEKGKSKKLKSVKELLGITIMERSSFEKNPIDFLEAKGYKEV
RKDLIVKLPKYSLFELENGRKRMLASAGELQKGNELALPSKYVNFLYLASHYEKLKGSPEDNEQK
QLFVEQHKHYLDEIIEQISEFSKRVILADANLDKVLSAYNKHRDKPIREQAENIIHLFTLTNLGAPAA
FKYFDTTIDRKRYTSTKEVLDATFIHQSITGLYETRIDLSQLGGD |
| 175 | MNKPYSIGLDIGTNSVGWSVVDDDYKVPAKKMRVFGDTDKGHIKKNLLGTLLFDSGETAESRRLK
RTARRRYTRRRNRILYLQEIFAKEMAKVDESFFHRLDESFLTDDDKTFDSHPIFGNKAEEDAYHQQ
FPTIYHLRKHLADSTEKADLRLVYLALAHMIKFRGHFLIEGELNAENTDVQKLFADFVGVYDRTFD
DSHLSEITVDASSILTEKISKSRRLEKLIKHYPTEKKNTLFGNLVALALGLQPNFKTNFKLSEDAKLQ
FSKDTYEEDLEELLGKIGDDYADLFTSAKNLYDAILLSGILTVDDESTKAPLSASMIKRYAEHHEDL
EKLKEFVKANKPELYHDIFKDESKNGYAGYIENGVKQDEFYKYLDKETLSKQDGSQYFLDKIEREDF
LRKQRTFDNGSIPHQLHLKEMRSILHRQGEYYPFLKENQAKIEKILTFRIPYYVGPLARKDSRFAWA
EYHSDEPITPWNFDEVVDKEKSAEKFITRMTLNDLYLPEEKVLPKHSHVYETYTVYNELTKVKYV
NEQGEAKFFDANMKQEIFDHVFKENRKVTKDKLMDFLGKEFDEFRIVDITGLDKENKAFNASLGT
YHDLKKILDKSFLDDKENETIIEDIIQTLTLFEDRDMIRQRLQKYSDIFTPQQLKKLERRHYTGWGRL
SYKLINGIRDKQTGKTILDYLIDDGYANRNFMQLINDDTLPFKEIIQKAQIIGDIDDIKAVVHDLPGSP
AIKKGILQSVKIVDELVKVMGHNPDNIVIEMARENQTTNRGRTQSQQRLKKLQESLKELGSNILNE
KKPSYVEDKVENTHLQNDRLFLYYIQNGKDMYTGDELDIDHLSDYDIDHIIPQAFIKDDSLDNRVLT
SSAKNRGKSDDVPSIEIVRDRKADWMRLRKAGLISKRKFDNLTKAERGGLTEADKAGFIKRQLVET
RQITKHVAQILDSRENTERDENDKVIREVKVITLKSNLVSQFRKDFQFYKVREINDYHHAHDAYLN
AVVGTALIKKYPKLESEFVYGDYKVYDVRKMIAKSEQEIGKATAKRFFYSNIMNFFKTEIKLANGE
IRKRPLIETNEETGEIVWNKEKDFATVRKVLSCPQVNIVKKTEVQTGGFSKESILPKRNSDKLIARKK
DWDPKKYGGFDSPTVAYSVLVVAKVEKGKSKKLKSVKELLGITIMERSSFEKNPIDFLEAKGYKEV
RKDLIVKLPKYSLFELENGRKRMLASAGELQKGNELALPSKYVNFLYLASHYEKLKGSPEDNEQK
QLFVEQHKHYLDEIIEQISEFSKRVILADANLDKVLSAYNKHRDKPIREQAENIIHLFTLTNLGAPAA
FKYFDTTIDRKRYTSTKEVLDATFIHQSITGLYETRIDLSQLGGD |
| 176 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDENFFQRLDDSFLVPDDKRDSKYPIFGNLVEEKVYHDEF
PTIYHLRKYLADSSKKADLRLVYLALAHMIKYRGHFLIEGDFNSRNNDIKKNFQDFLDSYNAIFESD
LSLENSKQLEEIVKDKISKSAKRERVLSLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIDRYENHQKDLA
ALKQFVKANLPEKYDEVFSDQSKDGYAGYIDGKTTQEAFYKYIKNTLSKIEGADYFLDKIEREDFL
RKQRTFDNGSIPHQIHLQEMNAIIRRQGEHYPFLQENKEKIEKILTFRIPYYVGPLARGNRDFAWLTR |

| SEQ ID NO | Nuclease Sequence |
|---|---|
| | NSDQAIRPWNFEEIVDQASSAEDFINKMTNYDLYLPEEKVLPKHSLLYETFAVYNELTKVKFIAEGL<br>RDYQFLDSGQKKQIVNQLFKEKRKVTEKDIIQFLHNVDGYDGIELKGIEKQFNASLSTYHDLLKIIK<br>DKEFMDDPKNEEILENIVHTLTIFEDREMIKQRLAQYDTLFDEKVIKALTRRHYTGWGKLSAKLIN<br>GICDKQTGDTILDYLIDDDKINRNFMQLINDDGLSFKDIIQKAQVVGKTDDVKQVVQELPGSPAIKK<br>GILQSIKIVDELVKVMGHAPESIVIEMARENQTTARGKKNSQQRYKRIEDALKNLAPGLDSNILKEN<br>PTDNIQLQNDRLFLYYLQNGKDMYTGEALDINQLSNYDIDHIVPQAFIKDDSLDNRVLTSSKDNRG<br>KSDNVPSLEVVQKRKAFWQQLLDSKLISERKENNLTKAERGGLDERDKVGFIKRQLVETRQITKHV<br>AQILDARFNTEVNEKNQKIRKVKIVTLKSNLVSNFRKEFKLYKVREINDYHHAHDAYLNAVVAKA<br>ILKKYPKLEPEFVYGDYQKYDVKRYISRKELTTSQDKATAKYFFYSNLLNFFKKEVRLADGTIVVR<br>PVIEYSKDTGEIAWNKEKDFATVRKVLSCPQVNIVKKTEVQTGGFSKESILPKRNSDKLIARKKDW<br>DPKKYGGFDSPTVAYSVLVVAKVEKGKSKKLKSVKELLGITIMERSSFEKNPIDFLEAKGYKEVRK<br>DLIVKLPKYSLFELENGRKRMLASAGELQKGNELALPSKYVNFLYLASHYEKLKGSPEDNEQKQLF<br>VEQHKHYLDEIIEQISEFSKRVILADANLDKVLSAYNKHRDKPIREQAENIIHLFTLTNLGAPAAFKY<br>FDTTIDRKRYTSTKEVLDATFIHQSITGLYETRIDLSQLGGD |
| 177 | MNKKYSIGLDIGTNSVGWAVVDDDYKVPAKKMRVFGDTDRSHIKKNLLGALLFDSGETAESRRL<br>KRTARRRYTRRRNRILYLQEIFAEEMAKVDESFFHRLDESFLTDDDKTFDSHPIFGNKAEEDAYHK<br>QFPTIYHLRKHLADSSEKADLRLVYLALAHMIKFRGHFLIEGELNAENTDVQKLFEQFVGVYDRTF<br>DDDSHLSEITVDASSILTEKISKSRRLEKLIKHYPTEKKNTLFGNLIALSLGLQPNFKTNFKLSEDAKLQ<br>FSKDTYEEDLEELLGKIGDDYADLFTLAKNLYDAILLSGILTVDDESTKAPLSASMIKRYAEHHEDL<br>EKLKEFVKANKPELYHDIFKDETKNGYAGYIENGVKQDEFYKYLKNTLSKIDGSQYFLDKIEREDF<br>LRKQRTFDNGSIPHQIHLQEMHAILHRQGEYYPFLKENQAKIEKILTFRIPYYVGPLARKNSRFAWA<br>NYHSDEPITPWNFDEVVDKEKSAEKFITRMTLNDLYLPEEKVLPKHSLVYETYTVYNELTKVKYV<br>NEQGKESFFDANMKQEIFDHVFKENRKVTKDKLLNYLDKEFPEYRIQDLIGLDKENKSFNASLGTY<br>HDLKKILDKSFLDDKENEQIIEDIIQTLTLFEDRDMIRQRLQKYSDIFTKQQLKKLERRHYTGWGRL<br>SYKLINGIRDKKSGKSILDYLIDDGYANRNFMQLINDDTLPFKQIIQKAQVVGDIDDIKAVVHDLPG<br>SPAIKKGILQSVKIVDELVKVMGHNPDNIVIEMARENQTTNRGRTQSQQRLKKLQESLKDLGSNIL<br>NEEKPSYIEDKVENSHLQNDKLFLYYIQNGKDMYTGDELDIDHLSDYDIDHIVPQAFIKDDSIDNRV<br>LTSSSKNRGKSDDVPSIEVVCARKADWMRLRKAGLISQRKFDNLTKAERGGLTEHDKAGFIKRQL<br>VETRQITKHVAQILDSRFNTKRDDNDKVIREVKVITLKSNLVSQFRKDFQFYKVREINDYHHAHDA<br>YLNAVVGTALIKKYPKLESEFVYGDYKVYDVRKMIAKSEQEIGKATAKRFFYSNIMNFFKTEIKLA<br>NGEIRKRPLIEVNEETGEIVWNKEKDFATVRKVLSCPQVNIVKKTEVQTGGFSKESILPKRNSDKLI<br>ARKKDWDPKKYGGFDSPTVAYSVLVVAKVEKGKSKKLKSVKELLGITIMERSSFEKNPIDFLEAK<br>GYKEVRKDLIVKLPKYSLFELENGRKRMLASAGELQKGNELALPSKYVNFLYLASHYEKLKGSPE<br>DNEQKQLFVEQHKHYLDEIIEQISEFSKRVILADANLDKVLSAYNKHRDKPIREQAENIIHLFTLTNL<br>GAPAAFKYFDTTIDRKRYTSTKEVLDATFIHQSITGLYETRIDLSQLGGD |
| 178 | MTKPYSIGLDIGTNSVGWAVITDSYKVPSKKMKVLGNTSKKYVKKNLLGALLFESGITAEGRRLK<br>RTARRRYTRRRNRILYLQEIFSTEMSKIDESFFQRLDDSFLVPDDKRDSKYPIFGNLVEEKAYHDEFP<br>TIYHLRKYLADSSKKADLRLVYLALAHMIKYRGHFLIEGDFNSKNNSIKKTFQQFLDSYNAIFEDDL<br>SLKNSEQLEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLAAL<br>KQFIQNNLQEKYDEVFSDQSKDGYAGYIDGKTTQEAFYKYIKETLSKIEGSDYFLDKIEREDFLRKQ<br>RTFDNGSIPHQIHLQEMNAILRRQGEHYPFLKENKEKIEKILTFRIPYYVGPLARGNRDFAWLTRNS<br>DQAIRPWNFEEVVDQASSAEEFINKMTNYDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLSTYHDLLKIIKD<br>KEFMDDPKNEEILENIVHTLTIFEDREMIKQRLAQYDSLFDEKVIKALTRRHYTGWGKLSAKLINGI<br>YDKQSKKTILDYLIDDDKINRNFMQLINDDGLSFKDIIQKAQVVGKTDDVKQVVQELPGSPAIKKGI<br>LQSIKLVDELVKVMGHAPESIVIEMARENQTTARGKKNSQQRYKRIEDALKNLAPGLDSNILKENP<br>TDNVQLQNDRLFLYYLQNGKDMYTGEALDINQLSNYDIDHIVPQAFIKDDSLDNRVLTSSKDNRG<br>KSDNVPSLEVVQKRKGFWQQLLDSKLISERKENNLTKAERGGLDERDKVGFIRRQLVETRQITKHV<br>AQILDERFNTEVDSKGKKIRKVKIITLKSNLVSNFRKEFGLYKVREINDYHHAHDAYLNAVVAKAI<br>LKKYPKLEPEFVYGDYQKYDIKRYISRKDPKEVEKATEKYFFYSNLLNFFKEEVHYADGTIVKRE<br>NIEYSNDTGEIAWNKEKDFATVRKVLSCPQVNIVKKTEVQTGGFSKESILPKRNSDKLIARKKDWD<br>PKKYGGFDSPTVAYSVLVVAKVEKGKSKKLKSVKELLGITIMERSSFEKNPIDFLEAKGYKEVRKD<br>LIVKLPKYSLFELENGRKRMLASAGELQKGNELALPSKYVNFLYLASHYEKLKGSPEDNEQKQLFV<br>EQHKHYLDEIIEQISEFSKRVILADANLDKVLSAYNKHRDKPIREQAENIIHLFTLTNLGAPAAFKYF<br>DTTIDRKRYTSTKEVLDATFIHQSITGLYETRIDLSQLGGD |
| 179 | MTKPYSIGLDIGTNSVGWAVITDSYKVPSKKMKVLGNTSKKYVKKNLLGALLFESGITAEGRRLK<br>RTARRRYTRRRNRILYLQEIFIAEMNKIDESFFQRLDDSFLVPDDKRGSKYPIFGNLAKEKTYHDEFP<br>TIYHLRKYLADSTKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIQNNLQEKYDEVFSDQSKDGYAGYIDGKTTQEAFYKYIKNLLSKFEGADYFLEKIKREDFL<br>RKQRTFDNGTIPYQVHLTEMKAILHRQGDYYPFLKENKEKIEQILTFRIPYYVGPLARGNRDFAWL<br>TRNSDQAIRPWNFEEVVDQASSAEDFINKMTNYDLYLPEEKVLPKHSLLYETFAVYNELTKVKFIA<br>EGLRDYQFLDSGQKKQIVNQLFKEKRKVTEKDIIHFLHNVDGYDGIELKGIEKQFNASLSTYHDLL<br>KIIKDKEFMDDAKNEAILENIIHTLTIFEDREMIKQRLAQYDSLFDEKVIKALTRRHYTGWGKLSAK<br>LINGIRDKQTGKTILDYLIDDGEINRNFMQLIHDDGLSFKEIIQKAQVVGKTDDLKQVVQELPGSPAI<br>KKGILQSIKIVDELVKVMGHAPESIVIEMARENQTTNQGKRNSQQRYKRIEDGVKNLASDLNGNIL<br>KEYPTDNQALQNDRLFLYYLQNGKDMYTGEPLDINQLSNYDIDHIVPQAFIKDDSLDNRVLTSSKD<br>NRGKSDNVPSIEVVEKMKGFWQQLLDSKLISERKFNNLTKAERGGLDERDKVGFIKRQLVETRQIT<br>KHVAQILDARFNTEVDEKGKKIRKVKIITLKSNLVSNFRKEFGLYKVREINDYHHAHDAYLNAVV |

| SEQ ID NO | Nuclease Sequence |
|---|---|
| | AKAILKKYPKLEPEFVYGDYQKYDLKRYISKSKNPKEIDKATEKYFFYSNLLNFFKEEVHYADGTII KRENIEYSKDTGEIAWNKEKDFATVRKVLSCPQVNIVKKTEVQTGGFSKESILPKRNSDKLIARKK DWDPKKYGGFDSPTVAYSVLVVAKVEKGKSKKLKSVKELLGITIMERSSFEKNPIDFLEAKGYKEV RKDLIVKLPKYSLFELENGRKRMLASAGELQKGNELALPSKYVNFLYLASHYEKLKGSPEDNEQK QLFVEQHKHYLDEIIEQISEFSKRVILADANLDKVLSAYNKHRDKPIREQAENIIHLFTLTNLGAPAA FKYFDTTIDRKRYTSTKEVLDATFIHQSITGLYETRIDLSQLGGD |
| 180 | MNKPYSIGLDIGTNSVGWAVITDSYKVPSKKMKVLGNTSKKYVKKNLLGALLFESGITAEGRRLK RTARRRYTRRRNRILYLQEIFAAEMNKIDESFFQRLDDSFLVPDDKRGSKYPIFGNLAKEKTYHDEF PTIYHLRKYLADSSKKADLRLVYLALAHMIKYRGHFLIEGDFNSKNNDIKKNFQEFLDSYNAIFESD LSLENSKQLEEIVKDKISKSAKRERVLKLFPDEKSTGLFSEFLKLIVGNQADFKKHFDLEEKAPLQFS KDTYDEDLENLLGQIGDDFADLFLVAKKLYDAILLSGILTVTDPSTKAPLSASMIERYENHQKDLAT LKQFIKTNLPEKYDEVFSDQSKDGYAGYIDKTTQEAFYKYIKNLLSKIEGADYFLEKIEREDFLRK QRTFDNGSIPHQIHLQEMNAILRRQGEHYPFLKENKEKIQQILTFRIPYYVGPLARGNRDFAWLTRN SDQAIRPWNFEEIVDQASSAEDFINKMTNYDLYLPEEKVLPKHSLLYETFAVYNELTKVKFIAEGLR DYQFLDSGQKKQIVNQLFKEKRKVTEKDIIHYLHNVDGYDGIELKGIEKQFNASLSTYHDLLKIIKD KEFMDDPKNEEILENIVHTLTIFEDREMIKQRLAQYDSLFDEKVIKALTRRHYTGWGKLSAKLINGI YDKQSKKTILDYLIDDGEINRNFMQLINDDGLSFKEIIQKAQVVGKTDDVKQVVQELPGSPAIKKGI LQSIKLVDELVKVMGHAPESIVIEMARENQTTARGKKNSQQRYKRIEDALKNLAPGLDSNILKENP TDNIQLQNDRLFLYYLQNGKDMYTGEALDINQLSSYDIDHIVPQAFIKDDSLDNRVLTSSKDNRGK SDNVPSLEVVQRKAFWQQLLDSKLISERKENNLTKAERGGLTEHDKAGFIKRQLVETRQITKHVA QILDERFNTEVNEEGKRIRKVKIITLKSNLVSNFRKEFGLYKVREINDYHHAHDAYLNAVVAKAILK KYPKLEPEFVYGEYKKYHIKSSLNSKTIDKATEKYFFYSNLLNFFKEEVHYADGTIIKRENIEYSKDT GEIAWNKEKDFATVRKVLSCPQVNIVKKTEVQTGGFSKESILPKRNSDKLIARKKDWDPKKYGGF DSPTVAYSVLVVAKVEKGKSKKLKSVKELLGITIMERSSFEKNPIDFLEAKGYKEVRKDLIVKLPKY SLFELENGRKRMLASAGELQKGNELALPSKYVNFLYLASHYEKLKGSPEDNEQKQLFVEQHKHYL DEIIEQISEFSKRVILADANLDKVLSAYNKHRDKPIREQAENIIHLFTLTNLGAPAAFKYFDTTIDRKR YTSTKEVLDATFIHQSITGLYETRIDLSQLGGD |
| 181 | MTKPYSIGLDIGTNSVGWAVISDSYKVPSKKMKVLGNTSKKYVKKNLLGALLFESGITAEGRRLKR TARRRYTRRRNRILYLQEIFSTEMAKIDESFFQRLDDSFLVPDDKRDSKYPIFGNLVEEKTYHDEFPT IYHLRKYLADSSKKADLRLVYLALAHMIKYRGHFLIEGDFNSRNNDIKKNFQNFLDSYNAIFESDLS LENSKQLEEIVKDKISKSAKRERVLKLFPDEKSTGLFSEFLKLIVGNQADFKKHFDLEEKAPLQFSK DTYDEDLENLLGQIGDDFADLFLVAKKLYDAILLSGILTVTDPSTKAPLSASMIERYENHQKDLAAL KQFIQNNLPEKYDEVFSDQSKDGYAGYINGKTTQEAFYKYIKNLLSKLEGADYFLDKIEREDFLRK QRTFDNGSIPHQIHLQEMNAIIRRQGEHYPFLKENKEKIEKILTFRIPYYVGPLARGNRDFAWLTRNS DQAIRPWNFEEVVDKASSAEDFINKMTNYDLYLPEEKVLPKHSLLYETFAVYNELTKVKFIAEGLR DYQFLDSGQKKQIVNQLFKEKRKVTEKDIIHYLHNVDGYDGIELKGIEKQFNASLSTYHDLLKIIKD KAFMDDAKNEEILENIVHTLTIFEDREMIKQRLAQYDSLFDEKVIKALTRRHYTGWGKLSARLIDGI YDKQSRKTILDYLIDDGEINRNFMQLIHDDGLSFKDIIQKAQVVGKTDDVKQVVQELPGSPAIKKGI LQSIKIVDELVKVMGHAPESIVIEMARENQTTARGKKNSQQRYKRIEDALKNLAPGLDSNILKENPT DNIQLQNDRLFLYYLQNGKDMYTGEALDINQLSNYDIDHIVPQAFIKDDSLDNRVLTSSKDNRGKS DNVPSLEVVQRRKAFWQQLLDSKLISERKENNLTKAERGGLTEHDKAGFIKRQLVETRQITKHVA QILDARFNTEVDEKGKRIRKVKIITLKSNLVSNFRKEFGLYKVREINDYHHAHDAYLNAVVAKAIL KKYPKLEPEFVYGDYQKYDIKRYISRSKDSKDIEKATEKYFFYSNLLNFFKEEVHYADGTIVKRENI EYSNDTGEIAWNKEKDFATVRKVLSCPQVNIVKKTEVQTGGFSKESILPKRNSDKLIARKKDWDPK KYGGFDSPTVAYSVLVVAKVEKGKSKKLKSVKELLGITIMERSSFEKNPIDFLEAKGYKEVRKDLI VKLPKYSLFELENGRKRMLASAGELQKGNELALPSKYVNFLYLASHYEKLKGSPEDNEQKQLFVE QHKHYLDEIIEQISEFSKRVILADANLDKVLSAYNKHRDKPIREQAENIIHLFTLTNLGAPAAFKYFD TTIDRKRYTSTKEVLDATFIHQSITGLYETRIDLSQLGGD |
| 182 | MKKPYSIGLDIGTNSVGWAVITDDYKVPSKKMKVLGNTSKKYVKKNLLGALLFESGITAEGRRLK RTARRRYTRRRNRILYLQEIFSTEMAQIDDSFFQRLDDSFLVPDDKRDSKYPIFGNLVEEKVYHDEF PTIYHLRKYLADSQKKADLRLVYLALAHMIKYRGHFLIEGDFNSRNNDIKKNFQDFLDSYNAIFES DLSLENSKQLEEIVKDKISKSAKRERVLKLFPDEKSTGLFSEFLKLIVGNQADFKKHFDLEEKAPLQF SKDTYDEDLENLLGQIGDDFADLFLVAKKLYDAILLSGILTVTDPSTKAPLSASMIERYENHQKDLA ALKQFIQNNLQEKYDEVFSDQSKDGYAGYIDGKTTQEAFYKYIKNLLSKFEGADYFLEKINRDDLL RKQRTFDNGSIPHQIHLQEMHAIIRRQGEYYPFLKENKEKIEKILTFRIPYYVGPLARGNRDFAWLTR NSDQAIRPWNFEEIVDKASSAEDFINKMTNYDLYLPEEKVLPKHSLLYETFAVYNELTKVKFIAEGL RDYQFLDSGQKKQIVNQLFKEKRKVTEKDIIHYLHNVDGYDGIELKGIEKQFNASLSTYHDLLKIIK DKEFMDDPKNEEILENIVHTLTIFEDREMIKQRLAQYDSLFDEKVIKALTRRHYTGWGKLSAKLING ICDKQTGNTILDYLIDDDKINRNFMQLINDDGLSFKEIIQKAQVVGKTDDNIKQVVQELPGSPAIKKGI LQSLKIVDELIEVMGYDPEHIVVEMARENQFTNQGRRNSQQRYKKIEDAIKNLDSNLNSKILKEYPT DNNALQNDRLFLYYLQNGKDMYTGEALDINQLSNYDIDHIIPQAFIKDDSLDNRVLTSSKDNRGKS DNVPSIEIVEKMKGFWQQLLNSKLISERKENNLTKAERGGLDERDKVGFIKRQLVETRQITKHVAQI LDARFNTEVNENNQKIRKVKIITLKSNLVSNFRKEFGLYKVREINDYHHAHDAYLNAVVAKAILKK YPKLEPEFVYGDYQKYDIKRYISRSKDPKDIEKATEKYFFYSNLLNFFKEEVHYADGTIIKRENIEYS KDTGEIAWNKEKDFATVRKVLSCPQVNIVKKTEVQTGGFSKESILPKRNSDKLIARKKDWDPKKY GGFDSPTVAYSVLVVAKVEKGKSKKLKSVKELLGITIMERSSFEKNPIDFLEAKGYKEVRKDLIVKL PKYSLFELENGRKRMLASAGELQKGNELALPSKYVNFLYLASHYEKLKGSPEDNEQKQLFVEQHK HYLDEIIEQISEFSKRVILADANLDKVLSAYNKHRDKPIREQAENIIHLFTLTNLGAPAAFKYFDTTID RKRYTSTKEVLDATFIHQSITGLYETRIDLSQLGGD |

| SEQ ID NO | Nuclease Sequence |
|---|---|
| 183 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSQKKADLRLVYLALAHMIKYRGHFLIEGDFNSRNNDIKKNFQNFLDSYNAIFESD<br>LSLENNAQVEEIVKDKISKSAKRERVLKLFPDEKSTGLFSEFLKLIVGNQADFKKHFDLEEKAPLQF<br>SKDTYDEDLENLLGQIGDDFADLFLVAKKLYDAILLSGILTVTDPSTKAPLSASMIDRYENHQKDL<br>AALKQFIKANLPEKYDEVFSDQSKDGYAGYIDGKTTQEAFYKYIKNLLSKFEGADYFLEKIEREDF<br>LRKQRTFDNGSIPHQIHLQEMNAILRRQGEHYPFLKENKEKIEKILTFRIPYYVGPLARGNRDFAWL<br>TRNSDQAIRPWNFEEVVDQASSAEDFINKMTNYDLYLPEEKVLPKHSLLYETFAVYNELTKVKFIA<br>EGLRDYQFLDSGQKKQIVNQLFKEKRKVTEKDIIQFLHNVDGYDGIELKGIEKQFNASLSTYHDLL<br>KIIKDKEFMDDPKNEEILENIVHTLTIFEDREMIKQRLAQYDSLFDEKVIKALTRRHYTGWGKLSAK<br>LINGICDKQTGDTILDFLIDDDKINRNFMQLINDDGLSFKEIIQKAQVVGKTDDVKQVVQELPGSPAI<br>KKGILQSIKIVDELVKVMGYEPEQIVIEMARENQTTNQGRRNSQQRYKLIEDGVKNLASDLDGNIL<br>KEYPTDNQALQNDRLFLYYLQNGKDMYTGESLDINQLSSYDIDHIVPQAFIKDDSLDNRVLTSSKD<br>NRGKSDNVPSLEVVQKRKAFWQQLLDSKLISERKENNLTKAERGGLDERDKVGFIKRQLVETRQIT<br>KHVAQILDARFNTEVNENNQKIRKVKIITLKSNLVSNFRKEFGLYKVREINDYHHAHDAYLNAVV<br>AKAILKKYPKLEPEFVYGDYQKYDIKRYISRSKDPKAIEKATQKYFFYSNLLNFFKEEVHYADGTII<br>KRENIEYSKDTGEIAWNKEKDFPATVRKVLSCPQVNIVKKTEVQTGGFSKESILPKRNSDKLIARKK<br>DWDPKKYGGFDSPTVAYSVLVVAKVEKGKSKKLKSVKELLGITIMERSSFEKNPIDFLEAKGYKEV<br>RKDLIVKLPKYSLFELENGRKRMLASAGELQKGNELALPSKYVNFLYLASHYEKLKGSPEDNEQK<br>QLFVEQHKHYLDEIIEQISEFSKRVILADANLDKVLSAYNKHRDKPIREQAENIIHLFTLTNLGAPAA<br>FKYFDTTIDRKRYTSTKEVLDATFIHQSITGLYETRIDLSQLGGD |
| 184 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAEIDESFFQRLDDSFLVPDDKRDSKYPIFGNLVKEKTYHDEFP<br>TIYHLRKYLADSSKKADLRLVYLALAHMIKYRGHFLIEGDFNSKNNDIKKNFQEFLDSYNAIFESDL<br>SLENSKQLEEIVKDKISKSAKRERVLKLFPDEKSTGLFSEFLKLIVGNQADFKKHFDLEEKAPLQFSK<br>DTYDEDLENLLGQIGDDFADLFLVAKKLYDAILLSGILTVTDPSTKAPLSASMIERYENHQKDLAAL<br>KQFIKNNLPEKYDEVFSDDSKDGYAGYIDGKTSQEDFYKYLKKLLTGIEGADYFLEKIEREDFLRK<br>QRTFDNGVIPYQIHLQEMKAILHNQGEYYPFLKENKEKIEQILTFRIPYYVGPLARGNRDFAWLTRN<br>SDQAIRPWNFEEIVDKASSAEDFINKMTNYDLYLPEEKVLPKHSLLYERFAVYNELTKVKFIAEGLR<br>DYQFLDSGQKKQIVNQLFKEKRKVTEKDIIHYLHNVDGYDGIELKGIEKQFNASLSTYHDLLKIIKD<br>KEFMDDPKNEEILENIVHTLTIFEDREMIKQRLAQYDSLFDEKVIKALTRRHYTGWGKLSAKLINGI<br>CDKQTGDTILDYLIDDDKINRNFMQLIHDDGLSFKEIIQKAQVVGKTDDLKQVVQELPGSPAIKKGI<br>LQSIKIVDELVKVMGYEPEQIVIEMARENQTTNQGRRNSRQRYKLLEDGVKNLASDLNGNILKEYP<br>TDNQALQNDRLFLYYLQNGKDMYTGEALDINQLSSYDIDHIIPQAFIKDDSLDNRVLTSSKDNRGK<br>SDNVPSLEVVQKRKAFWQQLLDSKLISERKENNLTKAERGGLDERDKVGFIKRQLVETRQITKHVA<br>QILDARFNTELDENGKRIRKVKIITLKSNLVSNFRKEFGLYKVREINDYHHAHDAYLNAVVAKAIL<br>KKYPKLEPEFVYGDYQKYDLKRYISRSKDPKEVEKATEKYFFYSNLLNFFKEEVHYADGTIVKREN<br>IEYSKDTGEIAWNKEKDFATVRKVLSCPQVNIVKKTEVQTGGFSKESILPKRNSDKLIARKKDWDP<br>KKYGGFDSPTVAYSVLVVAKVEKGKSKKLKSVKELLGITIMERSSFEKNPIDFLEAKGYKEVRKDL<br>IVKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 185 | MTKPYSIGLDIGTNSVGWAVITDSYKVPSKKMKVLGNTSKKYVKKNLLGALLFESGITAEGRRLK<br>RTARRRYTRRRNRILYLQEIFATEMAKIDESFFQRLDDSFLVPDDKRDSKYPIFGNLAQEKTYHDEF<br>PTIYHLRKYLADSSKKADLRLVYLALAHMIKYRGHFLIEGDFNSRNNDIKKNFQNFLDSYNAIFESD<br>LSLKNSEQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIQNNLPEKYDEVFSDESKDGYAGYIDGKTTQEAFYKYIKNLLSKLEGADYFLDKIEREDFL<br>RKQRTFDNGSIPHQIHLQEMNAILRRQGEHYPFLQENKEKIEKILTFRIPYYVGPLARGNRDFAWLT<br>RNSDQAIRPWNFEEVVDKASSAEDFINKMTNYDLYLPEEKVLPKHSLLYERFAVYNELTKVKFIAE<br>GLRDYQFLDSGQKKQIVNQLFKEKRKVTEKDIIHYLHNVDGYDGIELKGIEKQFNASLSTYHDLLKI<br>IKDKEFMDDPKNEEILENIIHTLTIFEDREMIKQRLAQYDSLFDEKVIKALTRRHYTGWGKLSAKLIN<br>GIYDKQSKKTILDYLIDDDKINRNFMQLINDDGLSFKDIIQKAQVVGKTDDVKQVVQNLPGSPAIK<br>KGILQSIKIVDELVKVMGSDPESIVIEMARENQTTNQGRRNSQQRYKKIEDAIKNLDSNLNSKILKE<br>YPTDNQALQNDRLFLYYLQNGKDMYTGEPLDINQLSNYDIDHIVPQAFIKDDSLDNRVLTSSKDNR<br>GKSDNVPSEEVVKRMRGFWRQLLDSKLISQRKFDNLTKAERGGLTHDKAGFIKRQLVETRQITK<br>HVAQILDARFNTEVDEKNKRIRNVKIITLKSNLVSNFRKEFRLYKVREINDYHHAHDAYLNAVVAK<br>AILKKYPKLEPEFVYGDYQKYDIKRYIKRSKPHGTVEKATQKYFFYSNLLNFFKEEVHYADGTIVK<br>REAVEYSKDTGEIAWNKEKDFATVRKVLSCPQVNIVKKTEVQTGGFSKESILPKRNSDKLIARKKD<br>WDPKKYGGFDSPTVAYSVLVVAKVEKGKSKKLKSVKELLGITIMERSSFEKNPIDFLEAKGYKEVR<br>KDLIVKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDATFIHQSITGLYETRIDLSQLGGD |
| 186 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKTYHDEFP<br>TIYHLRKYLADSTKKADLRLVYLALAHMIKYRGHFLIEGDFNSRNNDIKKNFQDFLDSYNAIFESD<br>LSLENSKQLEEIVKDKISKSAKKDRLLKLFPGEKNSGIFSEFLKLIVGNQADFRKYFNLDEKASLHES<br>KESYDEDLETLLGHIGDDYSDVFLKAKKLYDAILLSGILTVTDNETEAPLSSAMIMRYKEHEEDLAL<br>LKAYIRKISLETYNEVFKDDTKNGYAGYIDGKTNQEDFYVYLKKLLTGLEGADYFLEKINREDLLR<br>KQRTFDNGTIPYQIHLQEMRAILDKQAKFYPFLAKNKEKIEKILTFRIPYYVGPLARGNSDFAWSIR<br>KRNEKITPWNFEDVIDKESSAEAFINRMTSFDLYLPEEKVLPKHSLLYETFTVYNELTKVKFIAEGM |

| SEQ ID NO | Nuclease Sequence |
|---|---|
| | RDYQFLDSKQKKDIVRLYFKGKRKVTDKDIIEYLHAIDGYDGIELKGIEKQFNSSLATYHDLLNIIN<br>DKEFLDDSSNEAIIEEIIHTLTIFEDREMIKQRLSKFENIFDKSVLKKLSRRHYTGWGKLSAKLINGIR<br>DEKSGKTILDYLIDDGVSNRNFMQLIHDDTLSFKKKIQKAQIIGDQDNIKQVVQSLPGSPAIKKGILQ<br>SIKIVDELVKVMGRRPESIVVEMARENQYTNQGKSNSQQRLKRLEESLKELGSKILKENVPVKLSKI<br>DNQALQNDRLYLYLQNGKDMYTGEELDIDRLSNYDIDHIIPQSFLTDNSIDNKVLVSSASNRGKS<br>DDVPSLEVVKKRKGFWHQLLKSKLISKRKFDNLTKAERGGLTEADKAGFIKRQLVETRQITKHVA<br>QILDARFNTEKDEDNKAIRTVKVITLKSNLVSQFRKDFELYKVREINDFHHAHDAYLNAVVATAIL<br>KKYPKLEPEFVYGEYKKYDIRKFITNSSDKATAKYFFYSNLMNFFKRVIRYANGKVIVRPVVEYSK<br>DTGEIAWNKEKDFATVRKVLSCPQVNIVKKTEVQTGGFSKESILPKRNSDKLIARKKDWDPKKYG<br>GFDSPTVAYSVLVVAKVEKGKSKKLKSVKELLGITIMERSSFEKNPIDFLEAKGYKEVRKDLIVKLP<br>KYSLFELENGRKRMLASAGELQKGNELALPSKYVNFLYLASHYEKLKGSPEDNEQKQLFVEQHKH<br>YLDEIIEQISEFSKRVILADANLDKVLSAYNKHRDKPIREQAENIIHLFTLTNLGAPAAFKYFDTTIDR<br>KRYTSTKEVLDATFIHQSITGLYETRIDLSQLGGD |
| 187 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKVDENFFQRLDDSFLVPDDKRDSKYPIFGNLVEEKAYHDE<br>FPTIYHLRKYLADSSKKADLRLVYLALAHMIKYRGHFLIEGDFNSRNNDIKKNFQDPFLDSYNAIFES<br>DLSLENSKQLEEIVKDKISKSAKRERVLKLFPDEKSTGLFSEFLKLIVGNQADFKKHFDLEEKAPLQF<br>SKDTYDEDLENLLGQIGDDFADLFLVAKKLYDAILLSGILTVTDPSTKAPLSASMIERYENHQKDLA<br>ALKQFVKANLPEKYDEVFSDQSKDGYAGYIDGKTTQEAFYKYIKNLLSKFEGADYFLEKIEREDFL<br>RKQRTFDNGSIPHQIHLQEMNAIIRRQGEYYPFLKENKEKIEKILTFRIPYYVGPLARGNRDFAWLTR<br>NSDQAIRPWNFEEIVDQASSAEEFINKMTNYDLYLPEEKVLPKHSLLYETFAVYNELTKVKFIAEGL<br>RDYQFLDSGQKKQIVNQLFKEKRKVTEKDIIQFLHNVDGYDGIELKGIEKQFNASLSTYHDLLKIIK<br>DKEFMDDPKNEEILENIVHTLTIFEDREMIKQRLAQYDSLFDEKVIKALARRHYTGWGKLSAKLIN<br>GIYDKQSKKTILDYLIDDDKINRNFMQLINDDGLSFKEIIQKAQVVGKTDDVKQVVQELPGSPAIKK<br>GILQSIKIVDELVKVMGHAPESIVIEMARENQTTNQGRRNSQQRYKKIQEAIKNLAPDLDGNILKEY<br>PTDNQALQNDRLFLYYLQNGKDMYTGESLDINQLSSYDIDHIVPQAFIKDDSLDNRVLTSSKDNRG<br>KSDNVPSLEVVQKRKAFWQQLLDSKLISERKENNLTKAERGGLNERDKVGFIKRQLVETRQITKHV<br>AQILDARFNTEVNEEGKRIRKVKIITLKSNLVSNFRKEFGLYKVREINDYHHAHDAYLNAVVAKAI<br>LKKYPKLEPEFVYGDYQKYDIKRYISRSKNPKEIDKATEKYFFYSNLLNFFKEEVHYADGTIVKREN<br>IEYSNDTGEIAWNKEKDFATVRKVLSCPQVNIVKKTEVQTGGFSKESILPKRNSDKLIARKKDWDP<br>KKYGGFDSPTVAYSVLVVAKVEKGKSKKLKSVKELLGITIMERSSFEKNPIDFLEAKGYKEVRKDL<br>IVKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 188 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLAQEKTYHDEF<br>PTIYHLRKYLADSSKKADLRLVYLALAHMIKYRGHFLIEGDFNSRNNDIKKNFQDFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLAS<br>LKQFIQNNLQEKYDEVFSDQSKDGYAGYIDGKTTQEAFYKYIKNLLSKFEGSDYFLDKIEREDFLR<br>KQRTFDNGSIPHQIHLQEMNAILRRQGEHYPFLKENKEKIEQILTFRIPYYVGPLARGNRDFAWLTR<br>NSDQAIRPWNFEEVVDQASSAEDFINKMTNYDLYLPEEKVLPKHSLLYETFAVYNELTKVKFIAEG<br>LRDYQFLDSGQKKQIVNQLFKEKRKVTEKDIIQFLHNVDGYDGIELKGIEKQFNASLSTYHDLLKII<br>KDKDFMDDPKNEEILENIVHTLTIFEDREMIKQRLAQYDSIFDEKVIKALTRRHYTGWGKLSAKLIN<br>GIYDKQSKKTILDYLIDDDKINRNFMQLINDDGLSFKEIIQKAQVVGKTDDVKQVVQELPGSPAIKK<br>GILQSIKIVDELVKVMGHAPESIVIEMARENQTTNQGRRNSQQRYKLIEDGVKNLASDLNGNILKEY<br>PTNNQALQNERLFLYYLQNGKDMYTGEALDINQLSSYDIDHIIPQAFIKDDSLDNRVLTSSKDNRG<br>KSDNVPSIEVVQKRKAFWQQLLDSKLISERKENNLTKAERGGLDERDKVGFIKRQLVETRQITKHV<br>AQILDARFNTEVNENNQKIRKVKIITLKSNLVSNFRKEFGLYKVREINDYHHAHDAYLNAVVAKAI<br>LKKYPKLEPEFVYGDYQKYDLKRYISKSKDPKDIEKATEKYFFYSNLLNFFKEEVHYADGTIIKREN<br>VEYSNDTGEIAWNKEKDFATVRKVLSCPQVNIVKKTEVQTGGFSKESILPKRNSDKLIARKKDWDP<br>KKYGGFDSPTVAYSVLVVAKVEKGKSKKLKSVKELLGITIMERSSFEKNPIDFLEAKGYKEVRKDL<br>IVKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 189 | MNKPYSIGLDIGTNSVGWAVVTDSYKVPSKKMKVLGNTSKKYVKKNLLGALLFESGITAEGRRLK<br>RTARRRYTRRRNRILYLQEIFSEEMNKIDDSFFQRLDDSFLVVEDKRGERHPIFGNLAQEKTYHEKF<br>PTIYHLRKYLADSSKKADLRLVYLALAHMIKYRGHFLIEGDFNSRNNDIKGTFQKFLDSYNAIFESD<br>LSLKNSEQLEEIVKDKISKSAKRERVLKLFPDEKSTGLFSEFLKLIVGNQADFKKHFDLEEKAPLQFS<br>KDTYDEDLENLLGQIGDGFADLFLVAKKLYDAILLSGILTVTDPSTKAPLSASMIERYENHQKDLA<br>ALKQFIQNNLQEKYDEVFSDQSKDGYAGYIDGKTTQEAFYKYIKNLLSKLEGADYFLDKIEREDFL<br>RKQRTFDNGSIPHQIHLQEMNAIIRRQGEHYPFLQENKEKIEKILTFRIPYYVGPLARGNRDFAWLTR<br>NSDQAIRPWNFEEIVDKASSAEDFINKMTNYDLYLPEEKVLPKHSLLYERFAVYNELTKVKFIAEGL<br>RDYQFLDSGQKKQIVNQLFKEKRKVTEKDIIHYLHNVDGYDGIELKGIEKQFNASLSTYHDLLKIIK<br>DKEFMDDPKNEEILENIVHTLTIFEDREMIKQRLAQYDSLFDEKVIKALTRRHYTGWGKLSAKLING<br>ICDKQTGNTILDYLIDDDKINRNFMQLINDDGLSFKDIIQKAQVVGKTDDVKQVVQELPGSPAIKKG<br>ILQSIKIVDELVKVMGHAPESIVIEMARENQTTNQGKRNSQQRYKRLEEGIKNLAKDLNGNILKEYP<br>TDNQALQNDRLFLYYLQNGKDMYTGEPLDINQLSSYDIDHIIPQAFIKDDSLDNRVLTSSKDNRGK<br>SDNVPSLEVVQKRKAFWQQLLDSKLISERKENNLTKAERGGLNELDKVGFIKRQLVETRQITKHVA<br>QILDERFNNEVDSKGKRIRKVKIITLKSNLVSNFRKEFGLYKVREINDYHHAHDAYLNAVVAKAIL<br>KKYPKLEPEFVYGDYQKYDIKRYISRSKDPKEIEKATEKYFFYSNLLNFFKEEVHYADGTIIKRENIE |

| SEQ ID NO | Nuclease Sequence |
|---|---|
|  | YSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 190 | MTKPYSIGLDIGTNSVGWAVISDSYKVPSKKMKVLGNTSKKYVKKNLLGALLFESGITAEGRRLKR<br>TARRRYTRRRNRILYLQEIFSTEMAKIDESFFQRLDDSFLVPDDKRDSKYPIFGNLVEEKTYHDEFPT<br>IYHLRKYLADSSKKADLRLVLALAHMIKYRGHFLIEGDFNSRNNDIKKNFQDFLDSYNAIFESDLS<br>LENSKQLEEIVKDKISKSAKRERVLKLFPDEKSTGLFSEFLKLIVGNQADFKKHFDLEEKAPLQFSK<br>DTYDEDLENLLGQIGDGFADLFLVAKKLYDAILLSGILTVTDPSTKAPLSASMIERYENHQKDLATL<br>KQFIKNNLSEKYDEVFSDQSKDGYAGYIDGKTTQEAFYKYIKNLLSKFEGSDYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEDFINKMTNYDLYLPEEKVLPKHSLLYETFAVYNELTKVKFIAEGLR<br>DYQFLDSGQKKQIVNQLFKEKRKVTEKDIIHYLHNVDGYDGIELKGIEKQFNASLSTYHDLLKIIKD<br>KEFMDDPKNEEILENIVHTLTIFEDREMIKQRLAQYDTLFDEKVIKALTRRHYTGWGKLSAKLINGI<br>RDNRTRKTILDYLIDDGEINRNFMQLIHDDGLSFKEIIQKAQVVGKTDDVKQVVQELPGSPAIKKGI<br>LQSIKLVDELVKVMGHAPESIVIEMARENQTTARGKKNSQQRYKRIEDALKNLAPGLDSNILKENP<br>TDNIQLQNDRLFLYYLQNGRDMYTGEPLDINQLSNYDIDHIVPQAFIKDDSLDNRVLTSSKDNRGK<br>SDNVPSIEVVQKRKGFWRQLLDSQLISQRKFDNLTKAERGKLTEKDKAGFIKRQLVETRQITKHVA<br>QILDARFNTKRDENDKVIRDVKIITLKSNLVSNFRKEFGLYKVREINDYHHAHDAYLNAVVAKAIL<br>KKYPKLEPEFVYGDYQKYDIKRYISRSKDPKDVEKATEKYFFYSNLLNFFKEEVHYADGTIIKRENI<br>EYSKDTGEIAWNKEKDFATVRKVLSCPQVNIVKKTEVQTGGFSKESILPKRNSDKLIARKKDWDPK<br>KYGGFDSPTVAYSVLVVAKVEKGKSKKLKSVKELLGITIMERSSFEKNPIDFLEAKGYKEVRKDLI<br>VKLPKYSLFELENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTLTNLGAPAAFKYFD<br>TTIDRKRYTSTKEVLDATFIHQSITGLYETRIDLSQLGGD |
| 191 | MKKSYSIGLDIGTNSVGWAVVDDDYKVPAKKMRVFGDTDRSHIKKNLLGTLLFDSGETAESRRLK<br>RTARRRYTRRRNRILYLQEIFAEEMAKVDDSFFHRLDESFLTDDDKTFDSHPIFGNKAEEDAYHQK<br>FPTIYHLRKHLADSTEKADLRLVYLALAHMIKFRGHFLIEGQLNAENTDVQTLFNDPFVEVYDKTVE<br>ESHLAEITVDALSILTEKVSKSRRLENLIKYYPTEKKNTLFGNLVALALGLQPNFKTNFKLSEDAKL<br>QFSKDTYEEDLEELLGKIGDEYADLFTSAKNLYDAILLSGILTVDDNSTKAPLSASMIKRYEEHHED<br>LEKLKTFVKANNSDKYHEIFSDKDKNGYAGYIENGVKQDEFYKYLKNTLSKIAGSDYFLDKIERED<br>FLRKQRTFDNGSIPHQIHLQEMHAILRRQGDYYPFLKENQDRIEKILTFRIPYYVGPLARKDSRFAW<br>ANYHSDEPITPWNFDEVVDKEKSAEKFITRMTLNDLYLPEEKVLPKHSHVYETFAVYNELTKIKYV<br>NEQGKSFFFDANMKQEIFDHVFKENRKVTKDKLLDFLNKEFEEFRIVDLIGLDKENKSFNASLGTY<br>HDLKKILDKSFLDDKTNEQIIEDIVLTLTLFEDRDMIRQRLQKYSDIFTKQQLKKLERRHYTGWGRL<br>SYKLINGIRNKENNKTILDFLIDDGRANRNFMQLINDDSLSFKTIIQEAQVVGDVDDIEAVVHDLPG<br>SPAIKKGILQSVKIVDELVKVMGHNPDNIVIEMARENQTTNRGRVQSQQRLKKLQESLKELGSEILN<br>VEKPSYVEGKVENNHLQNDKLFLYYIQNGKDMYTGEELDIDHLSDYDIDHIIPQAFIKDDSIDNRVL<br>TSSAKNRGKSDDVPSLEIVHDRKADWIRLYKSGLISKRKFDNLTKAERGGLTEADKAGFIKRQLVE<br>TRQITKHVAQILDARFNTERDENDKVIRDVKITLKSNLVSQFRKDFKFYKVREINDYHHAHDAYL<br>NAVVGTALLKKYPKLAPEFVYGEYKKYDIRKFITNSSDKATAKYFFYSNLLNFFKTKVRYADGTIL<br>VRPVIEYSKDTGEIAWNKEKDFATVRKVLSCPQVNIVKKTEVQTGGFSKESILPKRNSDKLIARKKD<br>WDPKKYGGFDSPTVAYSVLVVAKVEKGKSKKLKSVKELLGITIMERSSFEKNPIDFLEAKGYKEVR<br>KDLIVKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDATFIHQSITGLYETRIDLSQLGGD |
| 192 | MTKPYSIGLDIGTNSVGWAVITDSYKVPSKKMKVLGNTSKKYVKKNLLGALLFESGITAEGRRLK<br>RTARRRYTRRRNRILYLQEIFATEMNKVDESFFHRLDDSFLVPEDKRGERHPIFGNLEEEKAYHEKF<br>PTIYHLRKYLADSSKKADLRLVYLALAHMIKYRGHFLIEGDFNSRNNDIKKNFQEFLDSYNAIFESD<br>LSLENSAQVEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVDDPSTKAPLSASMIERYENHQKDLA<br>ALKQFVKTNLPEKYDEVFSDQSKDGYAGYINGKTTQEAFYKYIKNLLSKLEGADYFLDKIEREDFL<br>RKQRTFDNGSIPHQIHLQEMNAILRRQGEHYPFLKENKEKIEKILTFRIPYYVGPLARGNRDFAWLT<br>RNSDQAIRPWNFEEVVDKASSAEDFINKMTNYDLYLPEEKVLPKHSLLYETFAVYNELTKVKFIAE<br>GLRDYQFLDSGQKKQIVNQLFKEKRKVTEKDIIHYLHNVDGYDGIELKGIEKQFNASLSTYHDLLKI<br>IKDKEFMDDPKNEEILENIVHTLTIFEDREMIKQRLAQYDSLFDEKVIKALTRRHYTGWGKLSAKLI<br>NGIRDKKSGKTILDYLIDDGEINRNFMQLIHDDGLSFKEIIQKAQVFGKTDDVKQVVQELPGSPAIK<br>KGILQSIKIVDELVKVMGHAPESIVIEMARENQTTNQGKRNSQQRYKRLEDGIKNLAKDLNGKILK<br>EYPTDNQALQNERLFLYYLQNGKDMYTEELDINQLSNYDIDHIIPQAFIKDDSLDNRVLTSSKDN<br>RGKSDNVPSIEVVEKMKAFWKQLLDSKLISERKYNNLTKAERERDGLNELDKVGFIKRQLVETRQI<br>TKHVAQILDARFNTEVNEKGKKIRKVKIITLKSNLVSNFRKEFGLYKVREINDYHHAHDAYLNAVL<br>AKAILKKYPKLEPEFVYGDYQKYDIKRYISKSKDPKDIDKATEKYFFYSNLLNFFKEEVHYADGTIV<br>KRENIEYSKDTGEIAWNKEKDFATVRKVLSCPQVNIVKKTEVQTGGFSKESILPKRNSDKLIARKK<br>DWDPKKYGGFDSPTVAYSVLVVAKVEKGKSKKLKSVKELLGITIMERSSFEKNPIDFLEAKGYKEV<br>RKDLIVKLPKYSLFELENGRKRMLASAGELQKGNELALPSKYVNFLYLASHYEKLKGSPEDNEQK<br>QLFVEQHKHYLDEIIEQISEFSKRVILADANLDKVLSAYNKHRDKPIREQAENIIHLFTLTNLGAPAA<br>FKYFDTTIDRKRYTSTKEVLDATFIHQSITGLYETRIDLSQLGGD |
| 193 | MTKPYSIGLDIGTNSVGWAVITDSYKVPSKKMKVLGNTSKKYVKKNLLGALLFESGITAEGRRLK<br>RTARRRYTRRRNRILYLQEIFSTEMSKIDESFFQRLDDSFLVPDDKRDSKYPIFGNLVEEKTYHDEFP |

| SEQ ID NO | Nuclease Sequence |
|---|---|
| | TIYHLRKYLADSSKKADLRLVYLALAHMIKYRGHFLIEGEFNSKNNDIKKNFQEFLDSYNAIFESDL
SLENSAQVEEIVKDKISKSAKRERVLKLFPDEKSTGLFSEFLKLIVGNQADFKKHFELEEKAPLQFSK
DTYDEDLENLLGQIGDDFADLFLVAKKLYDAILLSGILTVTDPSTKAPLSASMIERYENHQKDLAAL
KQFIKANLPEKYDEVFSDQSKDGYAGYINGKTTQEAFYKYIKNLLSKLEGADYFLDKIEREDFLRK
QRTFDNGSIPHQIHLQEMNAIIRRQGEHYPFLKENKEKIQQILTFRIPYYVGPLARGNRDFAWLTRNS
DQAIRPWNFEEIVDKASSAEEFINKMTNYDLYLPEEKVLPKHSLLYETFAVYNELTKVKFIAEGLRD
YQFLDSGQKKQIVNQLFKDKRKVTEKDIIHYLHTVDGYDGIELKGIEKQFNASLSTYHDLLKIIKDK
EFMDDPKNEEILENIVHTLTIFEDREMIKQRLAQYASIFDEKVIKALTRRHYTGWGKLSAKLINGIY
DKQSKKTILDYLIDDGEINRNFMQLIHDDGLSFKEIIQKAQVVGKTDDLKQVVQELPGSPAIKKGIL
QSIKIVDELVKVMGHAPESIVIEMARENQTTNQGKRNSQQRYKRIEDAIKNLSIDLNSKILKEYPTD
NQALQNDRLFLYYLQNGKDMYTGEALDINQLSNYDIDHIIPQAFIKDDSLDNRVLTSSKDNRGKSD
NVPSLEIVEKMKGFWQQLLDSKLISERKENNLTKAERGGLDERDKVGFIKRQLVETRQITKHVAQI
LDARFNTEVNEKKQKIRTVKIITLKSNLVSNFRKEFGLYKVREINDYHHAHDAYLNAVVAKAILKK
YPKLEPEFVYGDYQKYDIKRYISRSKDPKEVEKATQKYFFYSNLLNFFKEEVHYADGTIIKRENIEY
SKDTGEIAWNKEKDFATVRKVLSCPQVNIVKKTEVQTGGFSKESILPKRNSDKLIARKKDWDPKK
YGGFDSPTVAYSVLVVAKVEKGKSKKLKSVKELLGITIMERSSFEKNPIDFLEAKGYKEVRKDLIV
KLPKYSLFELENGRKRMLASAGELQKGNELALPSKYVNFLYLASHYEKLKGSPEDNEQKQLFVEQ
HKHYLDEIIEQISEFSKRVILADANLDKVLSAYNKHRDKPIREQAENIIHLFTLTNLGAPAAFKYFDT
TIDRKRYTSTKEVLDATFIHQSITGLYETRIDLSQLGGD |
| 194 | MNKPYSIGLDIGTNSVGWAVITDDYKVPSKKMKVLGNTSKKYVKKNLLGALLFESGITAEGRRLK
RTARRRYTRRRNRILYLQEIFSSEMDKIDESFFQRLDDSFLVPDDKRDSKYPIFGNLVEEKTYHDEFP
TIYHLRKYLADSSKKADLRLVYLALAHMIKYRGHFLIEGDFNSRNNDIKKNFQDFLDSYNAIFESDL
SLENSKQLEEIVKDKISKSAKRERVLKLFPDEKSTGLFSEFLKLIVGNQADFKKHFDLEEKAPLQFSK
DTYDEDLENLLGQIGDDFADLFLVAKKLYDAILLSGILTVTDPSTKAPLSASMIERYENHQKDLAQL
KQFVRRNIPEKYDEVFADQSKNGYAGYIDGKTTQEEFYKYIKNALNKIEGADYFLDKIEREDFLRK
QRTFDNGSIPHQIHLQEMNAIIRRQGEHYPFLKENKEKIEKILTFRIPYYVGPLARGNRDFAWLTRNS
DQAIRPWNFEEVVDQASSAEDFINKMTNYDLYLPEEKVLPKHSLLYETFAVYNELTKVKFIAEGLR
DYQFLDSGQKKQIVNQLFKEKRKVTEKDIIQPLHNVDGYDGIELKGIEKQFNASLSTYHDLLKIIKD
KEFMDDPKNEEILENIVHTLTIFEDREMIKQRLAQYDSLFDEKVIKALTRRHYTGWGKLSAKLINGI
RDKQSQKTILDYLIDDDKINRNFMQLINDDGLSFKEIIQKAQVVGKTDDVKQVVQELPGSPAIKKGI
LQSIKIVDELVKVMGHAPESIVIEMARENQTTARGKKNSQQRYKRIEDSLKNLAIGLDSKILKEHPT
DNQALQNDRLFLYYLQNGKDMYTGKELDINQLSNYDIDHIIPQAFIKDDSLDNRVLTSSKDNRGKS
DDVPSIEIVKARKGFWQQLLNSKLISERKENNLTKAERGGLDERDKVGFIKRQLVETRQITKHVAQI
LDARFNTEVDENGKRIRKVKIITLKSNLVSNFRKEFGLYKVREINDYHHAHDAYLNAVVAKAILKK
YPKLEPEFVYGDYQKYDIKRYISRSKDPKDIEKATEKYFFYSNLLNFFKEEVHYADGTILKRENIEY
SNDTGEIAWNKEKDFATVRKVLSCPQVNIVKKTEVQTGGFSKESILPKRNSDKLIARKKDWDPKK
YGGFDSPTVAYSVLVVAKVEKGKSKKLKSVKELLGITIMERSSFEKNPIDFLEAKGYKEVRKDLIV
KLPKYSLFELENGRKRMLASAGELQKGNELALPSKYVNFLYLASHYEKLKGSPEDNEQKQLFVEQ
HKHYLDEIIEQISEFSKRVILADANLDKVLSAYNKHRDKPIREQAENIIHLFTLTNLGAPAAFKYFDT
TIDRKRYTSTKEVLDATFIHQSITGLYETRIDLSQLGGD |
| 195 | MKKYSIGLDIGTNSVGWAVVDDDYKVPAKKMRVFGDTDRSHIKKNLLGTLLFDSGETAESRRLKR
TARRRYTRRRNRILYLQEIFAKEMAKVDESFFHRLDESFLTDDDKTFDSHPIFGNKAEEDAYHQKFP
TIYHLRKHLADSTEKADLRLVYLALAHMIKFRGHFLIEGELNAENTDVQKLFAQFVGVYDRTFDDS
HLSEITVDASSILTEKISKSRRLENLIKHYPTEKKNTLFGNLVALALGLQPNFKTNFKLSEDAKLQFS
KDTYEEDLEELLGKIGDDYADLFTSAKNLYDAILLSGILTVDDESTKAPLSASMIKRYAEHHEDLEK
LKEFIKANKPELYHDIFKDETKNGYAGYIENGVKQDEFYKYLKNTLSKIEGSDYFLDKIEREDFLRK
QRTFDNGSIPHQIHLQEMHAILRRQGDYYPFLKENQDRIEKILTFRIPYYVGPLARKDSRFAWANYH
SDEPITPWNFDEVVDKEKSAEKFITRMTLNDLYLPEEKVLPKHSPVYETYTVYNELTKVKYVTEQG
KATFFDANMKQEIFEHVFKENRKVTKDKFLNYLNKEFPEYRIQDLIGLDKENKSFNASLGTYHDLK
KILDKSFLDDKTNEEIIEDIIQTLTLFEDRDMIRQRLQKYSDIFTKQQLKKLERRHYTGWGRLSYKLI
NGIRNKENNKTILDYLIDDGHANRNFMQLINDESLSFKTIIQEAQVVGDVDDIKAVVHDLPGSPAIK
KGILQSVKIVDELVKVMGDNPDNIVIEMARENQTTNRGRTQSQQRLKKLQDSLKELGSNILNEEKP
SYVEGKVENNHLQNDKLFYYIQNGKDMYTGEELDIDHLSDYDIDHIIPQAFIKDDSIDNRVLTSSA
KNRGKSDDVPSLDIVHDRKADWIRLYKSGLISKRKFDNLTKAERGGLTEADKAGFIKRQLVETRQI
TKHVAQILDARFNTERDENDKVIRDVKVITLKSNLVSQFRKDFQFYKVREINDYHHAHDAYLNAV
VGTALLKKYPKLAPEFVYGEYKKYDIRKFITASGDKATAKYFFYSNLLNFFKKVRYADGTVIVRP
VIEYSKDTGEIAWNKEKDFATVRKVLSCPQVNIVKKTEVQTGGFSKESILPKRNSDKLIARKKDWD
PKKYGGFDSPTVAYSVLVVAKVEKGKSKKLKSVKELLGITIMERSSFEKNPIDFLEAKGYKEVRKD
LIVKLPKYSLFELENGRKRMLASAGELQKGNELALPSKYVNFLYLASHYEKLKGSPEDNEQKQLFV
EQHKHYLDEIIEQISEFSKRVILADANLDKVLSAYNKHRDKPIREQAENIIHLFTLTNLGAPAAFKYF
DTTIDRKRYTSTKEVLDATFIHQSITGLYETRIDLSQLGGD |
| 196 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVKEKTYHDEF
PTIYHLRKYLADSSKKADLRLVYLALAHMIKYRGHFLIEGDFNSRNNDIKKNFQDFLDSYNAIFESD
LSLENSKQLEEIVKDKISKSAKKDRLLKLFPGEKNSGIFSEFLKLIVGNQADFRKYFNLDEKASLHES
KESYDEDLETLLGHIGDDYSDVFLKAKKLYDAILLSGILTVTDNETEAPLSSAMIMRYKEHEEDLAL
LKAYIRKISLETYNEVFKDDTKNGYAGYIDGKTNQEDFYVYLKKLLTGLEGADYFLEKINREDLLRR
KQRTFDNGSIPYQIHLQEMRAIIDKQAKFYPPLAKNKERIEKILTFRIPYYVGPLARGNSDFAWSIRK
RNEKITPWNFEDVIDKESSAEAFINRMTSFDLYLPEEKVLPKHSLLYETFTVYNELTKVRFIAESMR
DYQFLDSKQKKDIVRLYFKGKRKVTDKDIIEYLHAIDGYDGIELKGIEKQFNSSLSTYHDLLNIINDK
EFLDDSSNEAIIEEIIHTLTIFEDREMIKQRLSKFENIFDKSVLKKLSRRHYTGWGKLSAKLINGIRDE |

-continued

| SEQ ID NO | Nuclease Sequence |
|---|---|
| | KSGKTILDYLIDDGVSNRNFMQLIHDDTLSFKKKIQKAQIIGDQDNIKQVVQSLPGSPAIKKGILQSI KIVDELVKVMGREPESIVVEMARENQYTNQGKSNSQQRLKRLEESLKELGSKILKENVPAKLSKID NNALQNERLYLYYLQNGKDMYTGDDLDIDRLSNYDIDHIIPQAFLKDNSIDNKVLVSSASNRGKSD DVPSIEVVKARKTFWHQLLKSQLISQRKFDNLTKAERGGLTDDDKAGFIKRQLVETRQITKHVAQL LDSRFNTKRDDNDKVIREVKIITLKSSLVSQFRKDFKLYKVREINDYHHAHDAYLNAVVATAILKK YPKLEPEFVYGDYQKYDIRKYLSTKDNKDLGKATAKMFFYSNLMNFFKKEVRLADGTVVVRPVIE YSKDTGEIAWNKEKDFATVRKVLSCPQVNIVKKTEVQTGGFSKESILPKRNSDKLIARKKDWDPK KYGGFDSPTVAYSVLVVAKVEKGKSKKLKSVKELLGITIMERSSFEKNPIDFLEAKGYKEVRKDLI VKLPKYSLFELENGRKRMLASAGELQKGNELALPSKYVNFLYLASHYEKLKGSPEDNEQKQLFVE QHKHYLDEIIEQISEFSKRVILADANLDKVLSAYNKHRDKPIREQAENIIHLFTLTNLGAPAAFKYFD TTIDRKRYTSTKEVLDATFIHQSITGLYETRIDLSQLGGD |
| 197 | MTKPYSIGLDIGTNSVGWAVITDSYKVPSKKMKVLGNTSKKYVKKNLLGALLFESGITAEGRRLK RTARRRYTRRRNRILYLQEIFSTEMAKIDESFFQRLDDSFLVPDDKRDSKYPIFGNLVKEKTYHDEF PTIYHLRKYLADSSKKADLRLVYLALAHMIKYRGHFLIEGDFNSRNNDIKKNFQDFLDSYNAIFESD LSLENSKQLEEIVKDKISKSAKKDRLLKLFPGEKNSGIFSEFLKIVGNQADFRKYFNLDEKASLHES KESYDEDLETLLGHIGDDYSDVFLKAKKLYDAILLSGILTVTDNETEAPLSSAMIMRYKEHEEDLAL LKAYIRNISLETYNEVFKDDTKNGYAGYIDGKTNQEDFYVYLKKLLTGLEGADYFLEKINREDLLR KQRTFDNGSIPYQIHLQEMRAIIDKQAKFYPPLAKNKERIEKILTFRIPYYVGPLARGNSDFAWSIRK RNEKITPWNFEDVIDKESSAEAFINRMTSFDLYLPEEKVLPKHSLLYETFTVYNELTKVRFIAESMR DYQFLDSKQKKDIVRLYFKGKRKVTDKDIIDYLHAIDGYDGIELKGIEKQFNSSLSTYHDLLNIIND KEFLDDSSNEAIIEEIIHTLTIFEDREMIKQRLSKFENIFDKSVLKKLSRRHYTGWGKLSAKLINGIRD EKSGKTILDYLIDDGVSNRNFMQLIHDDTLTFKKKIQKAQYIEDQDNIKQVVQSLPGSPAIKKGILQS IKIVDELVKVMGGRKPESIVVEMARENQYTNQGKSNSQQRLKRLEESLKELGSKILKENVPAKLSK IDNNALQNERLYLYYLQNGKDMYTGDDLDIDRLSNYDIDHIIPQAFLKDNSIDNKVLKDNSIDNKVLVSSASNRGK SDDVPSLDVVKKRKTFWHQLLKSQLISQRKFDNLTKAERGGLTDDDKAGFIKRQLVETRQITKHV AQLLDSRFNTKRDDNDKVIRDVKIITLKSSLVSQFRKEFGLYKVREINDYHHAHDAYLNAVVATAI LKKYPKLEPEFVYGEYKKYDVRKFIAKSDKSLGKATAKMFFYSNLMNFFKKEVRLADGTVVVRP VVEYSNDTGEIAWNKEKDFATVRKVLSCPQVNIVKKTEVQTGGFSKESILPKRNSDKLIARKKDW DPKKYGGFDSPTVAYSVLVVAKVEKGKSKKLKSVKELLGITIMERSSFEKNPIDFLEAKGYKEVRK DLIVKLPKYSLFELENGRKRMLASAGELQKGNELALPSKYVNFLYLASHYEKLKGSPEDNEQKQLF VEQHKHYLDEIIEQISEFSKRVILADANLDKVLSAYNKHRDKPIREQAENIIHLFTLTNLGAPAAFKY FDTTIDRKRYTSTKEVLDATFIHQSITGLYETRIDLSQLGGD |
| 198 | MKKYSIGLDIGTNSVGWAVVDDDYKVPAKKMRVFGDTDRSHIKKNLLGTLLFDSGETAESRRLKR TARRRYTRRRNRILYLQEIFAEEMSKVDDSFFHRLDESFLTDDDKNFDSHPIFGNKAEEDAYHQKFP TIYHLRKHLADSTEKADLRLVYLALAHMIKFRGHFLIEGQLNAENTDVQTLFNDFVEVYDKTVEES HLSEITVDALSILTEKVSKSRRLENLIKYYPTEKKNTLFGNLIALALGLQPNFKTNFKLSEDAKLQFS KDTYEEDLEELLGKIGDDYADLFTSAKNLYDAILLSGILTVDDNSTKAPLSASMIKRYVEHHEDLE KLKDFIRANKPDFYHDIFKDENKNGYAGYIENGVKQDEFYKYLKNTLSKIAGSDYFLDKIEREDFL RKQRTFDNGSIPHQIHLQEMHAILRRQGDYYPFLKENQDRIEKILTFRIPYYVGPLARKDSRFAWAE YHLDKITPWNFDKVIDKEKSAEKFITRMTSNDLYLPEEKVLPKHSHVYETYAVYNELTKIKYVNE QGEESFFDANMKQEIFDHVFKENRKVTKEKLLNYLNKEFPEYRIQDLIGLDKENKSFNASLGTYHD LKKILDKSFLDDKTNEQIIEDIIQTLTFLEDRDMIRQRLQKYSDIFTKQQLKKLERRHYTGWGRLSY KLINGIRNKENNKTILDFLIDDGHANRNFMQLINDDSLSFKTIIQEAQVVGDVDDIEAVVHDLPGSP AIKKGILQSVKIVDELVKVMGHNPDNIVIEMARENQTTNRGRSQSQQRLKKLQESLKELGSNILNEE KPSYIEDKVENSQLQNDRLFLYYIQNGKDMYTGDELDIDHLSDYDIDHIIPQAFIKDDSIDNRVLTSS AKNRGKSDDVPSLDIVRDRKADWIRLYKSGLISKRKFDNLTKAERGGLTEADKAGFIKRQLVETRQ ITKHVAQILDARFNTKRDENDKVIRDVKVITLKSNLVSQFRKDFGFYKVREINDYHHAHDAYLNA VVGTALLKKYPKLAPEFVYGEYKKYDVRKLIVQSDQKYGKATAKMFFYSNLMNFFKKEVRLSDG TVIVRPVIEYSKDTGEIAWNKEKDFATVRKVLSCPQVNIVKKTEVQTGGFSKESILPKRNSDKLIAR KKDWDPKKYGGFDSPTVAYSVLVVAKVEKGKSKKLKSVKELLGITIMERSSFEKNPIDFLEAKGY KEVRKDLIVKLPKYSLFELENGRKRMLASAGELQKGNELALPSKYVNFLYLASHYEKLKGSPEDN EQKQLFVEQHKHYLDEIIEQISEFSKRVILADANLDKVLSAYNKHRDKPIREQAENIIHLFTLTNLGA PAAFKYFDTTIDRKRYTSTKEVLDATFIHQSITGLYETRIDLSQLGGD |
| 199 | MKKPYSIGLDIGTNSVGWAVVTDDYKVPAKKMKVLGNTDKSHIKKNLLGALLFDSGETAEGTRL KRTARRRYTRRRNRILYLQEIFAKEMAKVDESFFQRLEESFLTDFDSHPIFGNKAEEDAYHQ KFPTIYHLRKHLADSPEKADLRLVYLALAHMIKFRGHFLIEGQLNAENTDVQTLFNDFVEVYDKTV EESHLSEITVDALSILTEKVSKSRRLENLIKYYPTEKKNTLFGNLIALALGLQPNFKTNFKLSEDAKL QFSKDTYEEDLEELLGKIGDEYADLFTSAKNLYDAILLSGILTVDDNSTKAPLSASMLKRYVEHHE DLEKLKEFIKANKSELYHDIFKDKNKNGYAGYIENGVKQDEFYKYLKNTLSKIEGSDYFLDKIERE DFLRKQRTFDNGSIPHQIHLQEMHAILRRQGEYYPFLKENQAKIEKILTFRIPYYVGPLARKDSRFA WANYHSDEPITPWNFDEVVDKEKSAEKFITRMTLNDLYLPEEKVLPKHSHVYETYTVYNELTKIK YVNEQGKATFFDANMKQEIFEHVFKENRKVTKEKFLNYLNKEFPEYRIQDLIGLDKENKSFNASLG TYHDLKKILDKSFLDDKTNEQIIEDIIQTLTFLEDRDMIRQRLQKYSDIFTKQQLKKLERRHYTGWG RLSYKLINGIRNKENNKTILDYLIDDGYANRNFMQLINDDTLPFKQIIQEAQVVGDVDDIEAVVHDL PGSPAIKKGILQSVKIVDELVKVMGHNPDNIVIEMARENQTTNRGRSQSQQRLKKLQESLKELGSNI LNEEKPSYIEDKVENSHLQNDKLFLYYIQNGKDMYTGDELDIDHIIPQAFIKDDSIDNR VLTSSAKNRGKSDDVPSLDIVHDRKADWIRLYKSGLISKRKFDNLTKAERGGLTEADKAGFIKRQL VETRQITKHVAQILDSRFNTKRDENDKVIRDVKVITLKSNLVSQFRKDFQFYKVREINDYHHAHDA YLNAVVGTALLKKYPKLAPEFVYGEYKKYDIRKFISSSSDKATAKYFFYSNLLNFFKTKVRYADGT VIVRPVIEYSKDTGEIAWNKEKDFATVRKVLSCPQVNIVKKTEVQTGGFSKESILPKRNSDKLIARK KDWDPKKYGGFDSPTVAYSVLVVAKVEKGKSKKLKSVKELLGITIMERSSFEKNPIDFLEAKGYKE |

| SEQ ID NO | Nuclease Sequence |
|---|---|
| | VRKDLIVKLPKYSLFELENGRKRMLASAGELQKGNELALPSKYVNFLYLASHYEKLKGSPEDNEQ<br>KQLFVEQHKHYLDEIIEQISEFSKRVILADANLDKVLSAYNKHRDKPIREQAENIIHLFTLTNLGAPA<br>AFKYFDTTIDRKRYTSTKEVLDATFIHQSITGLYETRIDLSQLGGD |
| 200 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVEEKAYHDEF<br>PTIYHLRKYLADSSKKADLRLVYLALAHMIKYRGHFLIEGEFNSKNNDIKKNFQEFLDSYNAIFESD<br>LSLENSAQVEEIVKDKISKSAKRERVLSLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>QLKQFVRRNLPEKYAEVFADQSKNGYAGYIDGKTTQEEFYKYLKEELTGVKGADYFLEKIKREDF<br>LRKQRTFDNGSIPYQVHLTEMKAIIHRQGEHYPFLKENKEKIEKILTFRIPYYVGPLARGNRDFAWL<br>TRNSDQAIRPWNFEEIVDKASSAEDFINKMTNYDLYLPEEKVLPKHSLLYETFAVYNELTKVKFIAE<br>GLRDYQFPLDSGQKKQIVNQLFKEKRKVTEKDIIHYLHNVDGYDGIELKGIEKQFNASLSTYHDLLKI<br>IKDKEFMDDPKNEEILENIVHTLTIFEDREMIKQRLAQYDSLFDEKVIKALTRRHYTGWGKLSAKLI<br>NGICDKQTGDTILDYLIDDDKINRNFMQLINDDGLSFKEIIQKAQVVGKTDDVKQVVQELPGSPAIK<br>KGILQSIKIVDELVKVMGHAPESIVIEMARENQTTARGKKNSQQRYKRIEDSLKNLASGLDSNILKE<br>NPTDNVQLQNDRLFLYYLQNGRDMYTGKPLDINQLSNYDIDHIIPQAFIKDDSLDNRVLTSSKDNR<br>GKSDNVPSLEVVEKMKAFWQQLLDSKLISERKYNNLTKAERERGGLNELDKVGFIKRQLVETRQI<br>TKHVAQILDARFNTEVDDKGKRIRKVKIITLKSNLVSNFRKEFGLYKVREINDYHHAHDAYLNAVV<br>AKAILKKYPKLEPEFVYGDYQKYDIKRYISRSKDPKDIEKATEKYFFYSNLLNFFKEEVHYADGTII<br>KRENIEYSKDTGEIAWNKEKDFATVRKVLSCPQVNIVKKTEVQTGGFSKESILPKRNSDKLIARKK<br>DWDPKKYGGFDSPTVAYSVLVVAKVEKGKSKKLKSVKELLGITIMERSSFEKNPIDFLEAKGYKEV<br>RKDLIVKLPKYSLFELENGRKRMLASAGELQKGNELALPSKYVNFLYLASHYEKLKGSPEDNEQK<br>QLFVEQHKHYLDEIIEQISEFSKRVILADANLDKVLSAYNKHRDKPIREQAENIIHLFTLTNLGAPAA<br>FKYFDTTIDRKRYTSTKEVLDATFIHQSITGLYETRIDLSQLGGD |
| 201 | MKKPYSIGLDIGTNSVGWAVITDDYKVPAKKMKVLGNTDRSHIKKNLIGALLFDAGNTAEDRRLK<br>RTARRRYTRRRNRILYLQEIFAEEMNKIDESFFHRLDDSFLVPEDKRGSKYPIFATLQEEKEYHKQFP<br>TIYHLRKQLAESNEKADLRLVYLALAHMIKYRGHFLIDDPKFKVQNNDIQGLFEKFVEEYDNVQET<br>SLSKIKLNVTEILTAKIPKSEKQEQLLKNYPSEKKNTLFGNLIGLALGLTPNFKTNFSLENDAKLQISS<br>ESYEEDLGSLLALIGENFIELFSAVKNLSDGILLAGIVSDESPHAPLSTKMVIRFKEHEEDLAALKHFI<br>KANLPEKYDEVFSDDSKNGYAGYVGVDSKVRKRNGKLATEEEFYKYLKDILNNVKGADYFLEKI<br>KREDLLRKQRTFDNGTIPYQVHLEEMKAILQNQGEYYPFLKENKEKIQQILTFRIPYYVGPLARGNR<br>DFAWLTRNSDQAIRPWNFEEVVDKASSAEDFINKMTNYDLYLPEEKVLPKHSLLYETFAVYNELT<br>KVKFIAEGLRDYQFLDSGQKKQIVNQLFKEKRKVTEKDIIHYLHNVDGYDGIELKGIEKQFNASLST<br>YHDLLKIIKDKEFMDDPKNEEILENIVHTLTIFEDREMIKQRLAQYDSLFDEKVIKALTRRHYTGWG<br>KLSAKLINGICDKQTNKTILDFLIDDDKINRNFMQLINDDGLSFKDIIQKAQVVGKIDDVKQVVQEL<br>PGSPAIKKGILQSIKIVDELVKVMGHAPESIVIEMARENQTTARGKKNSQQRYKRIEDALKNLAPGL<br>DSNILKENPTDNIQLQNDRLFLYYLQNGKDMYTGEALDINQLSNYDIDHIVPQAFIKDDSLDNRVLT<br>SSKDNRGKSDNVPSIEVVQKRKAFWQQLLDSKLISERKENNLTKAERGGLDERDKVGFIKRQLVET<br>RQITKHVAQILDARFNTEVNEKNQKIRKVKIITLKSNLVSNFRKEFGLYKVREINDYHHAHDAYLN<br>AVVAKAILKKYPKLEPEFVYGDYQKYDLKRYISRSKDPKEIEKATEKYFFYSNLLNFFKEEVHYAD<br>GTIIKRENIEYSKDTGEIAWNKEKDFATVRKVLSCPQVNIVKKTEVQTGGFSKESILPKRNSDKLIAR<br>KKDWDPKKYGGFDSPTVAYSVLVVAKVEKGKSKKLKSVKELVGITIMERSSFEKDPVDFLEAKGY<br>KEVRKDLIIKLPKYSLFELENGRKRMLASAGELQKGNELALPSKYVNFLYLASHYEKLKGSPEDNE<br>QKQLFVEQHKHYLDEIIEQISEFSKRVILADANLDKVLSAYNKHRDKPIREQAENIIHLFTLTNLGAP<br>AAFKYFDTTIDRKRYTSTKEVLDATLIHQSITGLYETRIDLSQLGGD |
| 202 | MNKPYSIGLDIGTNSVGWSVVDDDYKVPAKKMRVFGDTDKGHIKKNLLGTLLFDSGETAESRRLK<br>RTARRRYTRRRNRILYLQEIFAKEMAKVDESFFHRLDESFLTDDDKTFDSHPIFGNKAEEDAYHQQ<br>FPTIYHLRKHLADSTEKADLRLVYLALAHMIKFRGHFLIEGELNAENTDVQKLFADFVGVYDRTFD<br>DSHLSEITVDASSILTEKISKSRRLEKLIKHYPTEKKNTLFGNLVALALGLQPNFKTNFKLSEDAKLQ<br>FSKDTYEEDLEELLGKIGDDYADLFTSAKNLYDAILLSGILTVDDESTKAPLSASMIKRYAEHHEDL<br>EKLKEFVKANKPELYHDIFKDESKNGYAGYIENGVKQDEFYKYLKETLSKQDGSQYFLDKIEREDF<br>LRKQRTFDNGSIPHQLHLKEMRSILHRQGEYYPFLKENQAKIEKILTFRIPYYVGPLARKDSRFAWA<br>EYHSDEPITPWNFDEVVDKEKSAEKFITRMTLNDLYLPEEKVLPKHSHVYETYTVYNELTKVKYV<br>NEQGEAKFFDANMKQEIFDHVFKENRKVTKDKLMDFLGKEFDEFRIVDITGLDKENKAFNASLGT<br>YHDLKKILDKSFLDDKENETIIEDIIQTLTLFEDRDMIRQRLQKYSDIFTPQQLKKLKRRHYTGWGRL<br>SYKLINGIRDKQTGKTILDYLIDDGYANRNFMQLINDDTLPFKEIIQKAQIIGDIDDIKAVVHDLPGSP<br>AIKKGILQSVKIVDELVKVMGHNPDNIVIEMARENQTTNRGRTQSQQRLKKLQESLKELGSNILNE<br>KKPSYVEDKVENTHLQNDRLFLYYIQNGKDMYTGDELDIDHLSDYDIDHIIPQAFIKDDSIDNRVLT<br>SSAKNRGKSDDVPSIEIVRDRKADWMRLRKAGLISKRKFDNLTKAERGGLTEADKAGFIKRQLVET<br>RQITKHVAQILDSRENTERDENDKVIREVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEIKLANGE<br>IRKRPLIETNEETGEIVWNKEKDFATVRKVLSCPQVNIVKKTEVQTGGFSKESILPKRNSDKLIARKK<br>DWDPKKYGGFDSPTVAYSVLVVAKVEKGKSKKLKSVKELLGITIMERSSFEKNPIDFLEAKGYKEV<br>RKDLIIKLPKYSLFELENGRKRMLASAGELQKGNELALPSKYVNFLYLASHYEKLKGSPEDNEQKQ<br>LFVEQHQYLDEIIEQISEFSKRVILADANLDKVLSAYNKHRDKPIREQAENIIHLFTLTNLGAPAAF<br>KYFDTTIDRKRYTSTKEVLDATLIHQSITGLYETRIDLSQLGGD |
| 203 | MKKPYSIGLDIGTNSVGWAVVTDDYKVPAKKMKVLGDTDKSHIKKNLLGTLLFESGETAEGRRLK<br>RTARRRYTRRRNRILYLQEIFAEEMNKVDDSFFQRLDESFLKDDDKNFDSHPIFGNKAEEDAYHQK<br>FPTIYHLRQYLADSPEKADLRLVYLALAHIIKYRGHELFEGDLKSENKDVQHLFNDFVEMFDKTVE<br>GSYLSENLPNVADVLVEKVSKSRRLENVLHYFPNEKKNGLFGNFIALALGLQPNFKTNFKLSEDAK |

| SEQ ID NO | Nuclease Sequence |
|---|---|
| | LQFSKDTYDEDLEELLGKIGDDYADLFVAAKNLYDAILLSGILTVTDPTTKAPLSASMIDRYEKHH<br>KDLALLKNLIKQNLTQEKYDEVFSDESKNGYAGYISGKVKQEEFYKYLKNTLSKIEGSDYFLDKIE<br>REDFLRKQRTFDNGSIPHQIHLQEMNAIIRRQGEHYPFLKENKEKIEKILTFRIPYYVGPLARGNRDF<br>AWLTRNSDQAIRPWNFEEIVDQASSAEDFINKMTNYDLYLPEEKVLPKHSLLYETFAVYNELTKVK<br>FIAEGLRDYQFLDSGQKKQIVNQLFKEKRKVTEKDIIQYLHNVDGYDGIELKGIEKQFNASLSTYHD<br>LLKIIKDKEFMDDPKNEEILENIVHTLTIFEDREMIKQRLAQYDSLFDEKVIKALTRRHYTGWGKLS<br>AKLINGIYDKQSKKTILDYLIDDGEINRNFMQLINDDGLSFKDIIQKAQVVGKTNDVKQVVQELPGS<br>PAIKKGILQSIKLVDELVKVMGHAPESIVIEMARENQTTARGKKNSQQRYKRIEDALKNLAPGLDS<br>NILKENPTDNIQLQNDRLFLYYLQNGKDMYTGEALDINQLSNYDIDHIVPQAFIKDDSLDNRVLTSS<br>KDNRGKSDNVPSIEVVQKRKAFWQQLLDSKLISERKENNLTKAERGGLDERDKVGFIKRQLVETR<br>QITKHVAQILDARFNTEVDENNQRIRKVKIITLKSNLVSNFRKEFGLYKVREINDYHHAHDAYLNA<br>VVAKAILKKYPKLEPEFVYGDYQKYDLKRYISRSKDPKDIEKATEKYFFYSNLLNFFKEEVHYADG<br>TIIKRENIEYSNDTGEIAWNKEKDFATVRKVLSCPQVNIVKKTEVQTGGFSKESILPKRNSDKLIPRK<br>TEWDPKKYGGFDSPIVAYSVLVVAKVEKGKSKKLKPVKELVGITIMERSSFEKDPVDFLEAKGYKE<br>VRKDLIIKLPKYSLFELENGRKRMLASAGELQKGNELALPSKYVNFLYLASHYEKLKGSPEDNEQK<br>QLFVEQHKHYLDEIVEQISEFSERVILADANLDKILSAYNKHRDKPIREQAENIINLFTFTNLGAPAA<br>FKFFDTDIDRKRYTSTKEVLDATLIHQSITGLYETRIDLSQLGGD |
| 204 | MKKPYSIGLDIGTNSVGWAVVTDDYKVPSKKMKVLGNTDKSHIKKNLLGALLFESGETAEGRRLK<br>RTARRRYTRRRNRILYLQEIFAEEMNKIDESFFHRLDDSFLVPEDKRGSKYPIFATLQEEKEYHKQFP<br>TIYHLRKQLAESNEKADLRLVYLALAHMIKYRGHFLIDDPKFKVQNNDIQGLFEKFVEEYDNVQET<br>SLSKIKLNVTEILTANIPKSEKQEQLLKNYPSEKKNTLFGNLIGLALGLTPNFKTNFSLENDAKLQISS<br>ESYEEDLGNLLALIGENFIELFSAVKNLSDGILLAGIVSDESPHAPLSTKMVIRFKEHEEDLAALKHFI<br>KANLPEKYDEVFSDDSKNGYAGYVGVDSKVRKRNGKLATEEEFYKYLKDILNNVKGADYFLEKI<br>KREDFLRKQRTFDNGTIPYQVHLTEMRAIIHRQGEHYPFLQENKEKIEKILTFRIPYYVGPLARGNR<br>DFAWLTRNSDQAIRPWNFEEVVDKASSAEDFINKMTNYDLYLPEEKVLPKHSLLYETFAVYNELT<br>KVKFIAEGLRDYQFLDSGQKKQIVNQLFKEKRKVTEKDIIHYLHNVDGYDGIELKGIEKQFNASLST<br>YHDLLKIIKDKEFMDDAKNEEILENIVHTLTIFEDREMIKQRLAQYDSLFDEKVIKALTRRHYTGWG<br>KLSAKLINGIYDKQSKKTILDYLIDDDKINRNFMQLINDDGLSFKDIIQKAQVVGKTNDVKQVVQE<br>LPGSPAIKKGILQSIKLVDELVKVMGHAPESIVIEMARENQTTARGKKNSQQRYKRIEDALKNLAPG<br>LDSNILKENPTDNIQLQNDRLFLYYLQNGKDMYTGEPLDINQLSSYDIDHIVPQAFIKDDSLDNRVL<br>TSSKDNRGKSDNVPSLEVVQKRKAFWQQLLDSKLISEHKFNNLTKAERGGLDERDKVGFIKRQLV<br>ETRQITKHVAQILDARFNTEVNEKKQKIRSVKIITLKSNLVSNFREFRLYKVREINDYHHAHDAYL<br>NAVVAKAILKKYPKLEPEFVYGDYQKYDIKRYISRSKDPKEVEKATQKYFFYSNLLNFFKEEVHYA<br>DGTIIKRENIEYSKDTGEIAWNKEKDFATVRKVLSCPQVNIVKKTEVQTGGFSKESILPKRNSDKLIP<br>RKTEWDPKKYGGFDSPTVAYSVLVVAKVEKGKSKKLKSVKELVGITIMERSSFEKDPVDFLEAKG<br>YKEVRKDLIIKLPKYSLFELENGRRLLASAGELQKGNELALPSKYVNFLYLASHYEKLKGSPEDN<br>EQKQLFVEQHKHYLDEIVEQISEFSERVILADANLDKVLSAYNKNRDRPIREQAENIIHLFTLTNLGA<br>PAAFKFFDTTIDRKRYTSTKEVLDATLIHQSITGLYETRIDLSQLGGD |
| 205 | MNKPYSIGLDIGTNSVGWSVVDDDYKVPAKKMRVFGDTDKGHIKKNLLGTLLFDSGETAESRRLK<br>RTARRRYTRRRNRILYLQEIFAKEMAKVDESFFHRLDESFLTDDKTFDSHPIFGNKAEEDAYHQQ<br>FPTIYHLRKHLADSTEKADLRLVYLALAHMIKFRGHFLIEGELNAENTDVQKLFADFVGYDRTFD<br>DSHLSEITVDASSILTEKISKSRRLEKLIKHYPTEKKNTLFGNLVALALGLQPNFKTNFKLSEDAKLQ<br>FSKDTYEEDLEELLGKIGDDYADLFTSAKNLYDAILLSGILTVDDESTKAPLSASMIKRYAEHHEDL<br>EKLKEFVKANKPELYHDIFKDESKNGYAGYIENGVKQDEFYKYLKETLSKQDGSQYFLDKIEREDF<br>LRKQRTFDNGSIPHQLHLKEMRSILHRQGEYYPFLKENQAKIEKILTFRIPYYVGPLARKDSRFAWA<br>EYHSDEPITPWNFDEVVDKEKSAEKFITRMTLNDLYLPEEKVLPKHSHVYETYTVYNELTKVKYV<br>NEQGEAKFFDANMKQEIFDHVFKENRKVTKDKLMDFLGKEFDEFRIVDITGLDKENKAFNASLGT<br>YHDLLKKILDKSFLDDKENETIIEDIIQTLTLFEDRDMIRQRLQKYSDIFTPQQLKKLERRHYTGWGRL<br>SYKLINGIRDKQTGKTILDYLIDDGYANRNFMQLINDDTLPFKEIIQKAQIIGDIDDIKAVVHDLPGSP<br>AIKKGILQSVKIVDELVKVMGHNPDNIVIEMARENQTTNRGRTQSQQRLKKLQESLKELGSNILNE<br>KKPSYVEDKVENTHLQNDRLFLYYIQNGKDMYTGDELDIDHLSDYDIDHIIPQAFIKDDSIDNRVLT<br>SSAKNRGKSDDVPSIEIVRDRKADWMRLRKAGLISKRKFDNLTKAERGGLTEADKAGFIKRQLVET<br>RQITKHVAQILDSRENTERDENDKVIREVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEIKLANGE<br>IRKRPLIETNEETGEIVWNKEKDFATVRKVLSCPQVNIVKKTEVQTGGFSKESILPKRNSDKLIPRKT<br>EWDPKKYGGFDSPIVAYSVLVVAKVEKGKSKKLKPVKELVGITIMERSSFEKDPVDFLEAKGYKE<br>VRKDLIIKLPKYSLFELENGRKRMLASAGELQKGNELALPSKYVNFLYLASHYEKLKGSPEDNEQK<br>QLFVEQHKHYLDEIVEQISEFSERVILADANLDKILSAYNKHRDKPIREQAENIINLETFTNLGAPAA<br>FKFFDTDIDRKRYTSTKEVLDATLIHQSITGLYETRIDLSQLGGD |
| 206 | MKKPYSIGLDIGTNSVGWAVVTDDYKVPAKKMKVLGTDKSHIKKNLLGTLLFESGETAEGRRLK<br>RTARRRYTRRRNRILYLQEIFAEEMNKVDDSFFQRLDESFLKDDDKNFDSHPIFGNKAEEDAYHQK<br>FPTIYHLRQYLADSPEKADLRLVYLALAHIIKYRGHELFEGDLKSENKDVQHLENDFVEMFDKTVE<br>GSYLSENLPNVADVLVEKVSKSRRLENVLHYFPNEKKNGLFGNFIALALGLQPNFKTNFKLSEDAK<br>LQFSKDTYDEDLEELLGKIGDDYADLFVAAKNLYDAILLSGILTVTDPTTKAPLSASMIDRYEKHH<br>KDLALLKNLIKQNLTQEKYDEVFSDESKNGYAGYISGKVKQEEFYKYLKNTLSKIEGSDYFLDKIE<br>REDFLRKQRTFDNGSIPHQIHLQEMNAIIRRQGEHYPFLKENKEKIEKILTFRIPYYVGPLARGNRDF<br>AWLTRNSDQAIRPWNFEEIVDQASSAEDFINKMTNYDLYLPEEKVLPKHSLLYETFAVYNELTKVK<br>FIAEGLRDYQFLDSGQKKQIVNQLFKEKRKVTEKDIIQYLHNVDGYDGIELKGIEKQFNASLSTYHD<br>LLKIIKDKEFMDDPKNEEILENIVHTLTIFEDREMIKQRLAQYDSLFDEKVIKALTRRHYTGWGKLS<br>AKLINGIYDKQSKKTILDYLIDDGEINRNFMQLINDDGLSFKDIIQKAQVVGKTNDVKQVVQELPGS<br>PAIKKGILQSIKLVDELVKVMGHAPESIVIEMARENQTTARGKKNSQQRYKRIEDALKNLAPGLDS |

| SEQ ID NO | Nuclease Sequence |
|---|---|
| | NILKENPTDNIQLQNDRLFLYYLQNGKDMYTGEALDINQLSNYDIDHIVPQAFIKDDSLDNRVLTSS
KDNRGKSDNVPSIEVVQKRKAFWQQLLDSKLISERKENNLTKAERGGLDERDKVGFIKRQLVETR
QITKHVAQILDARFNTEVDENNQRIRKVKIITLKSNLVSNFRKEFGLYKVREINDYHHAHDAYLNA
VVAKAILKKYPKLEPEFVYGDYQKYDLKRYISRSKDPKDIEKATEKYFFYSNLLNFFKEEVHYADG
TIIKRENIEYSNDTGEIAWNKEKDFATVRKVLSCPQVNIVKKTEVQTGGFSKESILPKRNSDKLIARK
KDWDPKKYGGFDSPTVAYSVLVVAKVEKGKSKKLKSVKELVGITIMERSSFEKDPVDFLEAKGYK
EVRKDLIIKLPKYSLFELENGRKRMLASAGELQKGNELALPSKYVNFLYLASHYEKLKGSPEDNEQ
KQLFVEQHKHYLDEIIEQISEFSKRVILADANLDKVLSAYNKHRDKPIREQAENIIHLFTLTNLGAPA
AFKYFDTTIDRKRYTSTKEVLDATLIHQSITGLYETRIDLSQLGGD |
| 207 | MKKPYSIGLDIGTNSVGWAVVTDDYKVPAKKMRVLGDTDRSHIKKNLIGALLFDAGNTAEDRRL
KRTARRRYTRRRNRILYLQEIFAEEMNKVDESFFHRLDDSFLVPEDKRGSKYPIFATLQEEKEYHKQ
FPTIYHLRKQLAESNEKADLRLIYLALAHMIKYRGHFLIDDPKFKVQNNDIQGLFEKFVEEYDNVQ
ETSLSKIKLNVTEILTANIPKSEKQEQLLKNYPSEKKNTLFGNLIGLALGLTPNFKTNFSLENDAKLQI
SSESYEEDLGNLLALIGENFIELFSAVKNLSDGILLAGIVSDESPHAPLSTKMVIRFKEHEEDLAALK
HFIKANLPEKYDEVFSDDSKNGYAGYVGVDSKVRKRNGKLATEEEFYKYLKDILNNVKGADYFLE
KIKREDFLRKQRTFDNGTIPYQVHLTEMRAILHRQGEYYPFLQENKEKIEKILTFRIPYYVGPLARG
NRDFAWLTRNSDQAIRPWNFEEIVDQASSAEDFINKMTNYDLYLPEEKVLPKHSLLYETFAVYNEL
TKVKFIAEGLRDYQFLDSGQKKQIVNQLFKEKRKVTEKDIIQYLHNVDGYDGIELKGIEKQFNASLS
TYHDLLKIIKDKEFMDDPKNEEILENIVHTLTIFEDREMIKQRLAQYDSLFDEKVVKALARRHYTG
WGKLSAKLINGIYDKQSKKTILDYLIDDGKINRNFMQLINDDGLSFKEIIQKAQVVGKTDDVKQVV
QELPGSPAIKKGILQSIKIVDELVKVMGHAPESIVIEMARENQTTARGKKNSQQRYKRIEDALKNLA
PGLDSNILKEHPTDNIQLQNDRLFLYYLQNGKDMYTGEPLDINQLSSYDIDHIVPQAFIKDDSLDNR
VLTSSKDNRGKSDNVPSLEVVQKRKAFWQQLLDSKLISERKENNLTKAERGGLDERDKVGFIRRQ
LVETRQITKHVAQILDARFNTEVNEKNQKIRTVKIITLKSNLVSNFRKEFGLYKVREINDYHHAHDA
YLNAVLAKAILKKYPKLEPEFVYGDYQKYDLKRYISRSRDPKEIEKATEKYFFYSNLLNFFKEEVH
YADGTIIKRENIEYSKDTGEIAWNKEKDFATVRKVLSCPQVNIVKKTEVQTGGFSKESILPKRNSDK
LIARKKDWDPKKYGGFDSPTVAYSVLVVAKVEKGKSKKLKSVKELLGITIMERSSFEKNPIDFLEA
KGYKEVRKDLIIKLPKYSLFELENGRKRMLASAGELQKGNELALPSKYVNFLYLASHYEKLKGSPE
DNEQKQLFVEQHKHYLDEIIEQISEFSKRVILADANLDKVLSAYNKHRDKPIREQAENIIHLFTLTNL
GAPAAFKYFDTTIDRKRYTSTKEVLDATLIHQSITGLYETRIDLSQLGGD |
| 208 | MKKSYSIGLDIGTNSVGWAVVNDDYKVPAKKMRVFGDTDRSHIKKNLLGTLLFDSGETAEGRRL
KRTARRRYTRRRNRILYLQEIFAEEMNKIDESFFHRLDDSFLVPEDKRGSKYPIFATLAEEKEYHKQ
FPTIYHLRKKLAESNEKADLRLVYLALAHMIKYRGHFLIDDPKFKVQNNDIQGLFEKFVEEYDNVQ
ETSLSKIKLNVTEILTANIPKSEKQEQLLKNYPSEKKNTLFGNLIGLALGLTPNFKTNFSLENDAKLQI
SSESYEEDLGNLLALIGENFIELFSAVKNLSDGILLAGIVSDESPHAPLSTKMVIRFKEHEEDLAALK
HFIKANLPEKYDEVFSDDSKNGYAGYVGVDSKVRKRNGKLATEEEFYKYLKNILNNIKGADYFLE
KIEREDLLRKQRTFDNGTIPYQVHLAEMRAILHRQGDYYPFLKENREKIEKILTFRIPYYVGPLARG
NRDFAWLTRNSDQAIRPWNFEEVVDQASSAEDFINKMTNYDLYLPEEKVLPKHSLLYETFAVYNE
LTKVKFIAEGLRDYQFLDSGQKKQIVNQLFKEKRKVTEKDIIHYLHNVDGYDGIELKGIEKQFNASL
STYHDLLKIIKDKEFMDDPKNEEILENIVHTLTIFEDREMIKQRLAQYDSLFDEKVIKALTRRHYTG
WGKLSAKLINGICDKQTGNTILDYLIDDDKINRNFMQLINDDGLSFKEIIQKAQVVGKTDDVKQVV
QELPGSPAIKKGILQSIKIVDELVKVMGHAPESIVIEMARENQTTARGKKNSQQRYKRIEDALKNLA
PGLDSNILKEHPTDNIQLQNDRLFLYYLQNGKDMYTGESLDINQLSSYDIDHIVPQAFIKDDSLDNR
VLTSSKDNRGKSDNVPSIEVVQKRKAFWQQLLDSKLISERKENNLTKAERGGLDERDKVGFIKRQL
VETRQITKHVAQILDARFNTEVNEKGQKIRKVKIITLKSNLVSNFRKEFGLYKVREINDYHHAHDA
YLNAVVAKAILKKYPKLEPEFVYGDYQKYDIKRYISKSKDPKEIEKATEKYFFYSNLLNFFKEEVH
YADGTIIKRENIEYSKDTGEIAWNKEKDFATVRKVLSCPQVNIVKKTEVQTGGFSKESILPKRNSDK
LIPRKTEWDPKKYGGFDSPTVAYSVLVVAKVEKGKSKKLKSVKELVGITIMERSSFEKDPVDFLEA
KGYKEVRKDLIIKLPKYSLFELENGRRRLLASAGELQKGNELALPSKYVNFLYLASHYEKLKGSPE
DNEQKQLFVEQHKHYLDEIVEQISEFSERVILADANLDKVLSAYNKNRDRPIREQAENIIHLFTLTNL
GAPAAFKFFDTTIDRKRYTSTKEVLDATLIHQSITGLYETRIDLSQLGGD |
| 209 | MKKPYSIGLDIGTNSVGWAVVTDDYKVPAKKMKVLGDTDKSHIKKNLLGTLLFESGETAEGRRLK
RTARRRYTRRRNRILYLQEIFAEEMNKVDDSFFQRLDESFLKDDDKNFDSHPIFGNKAEEDAYHQK
FPTIYHLRQYLADSPEKADLRLVYLALAHIIKYRGHELFEGDLKSENKDVQHLFNDFVEMEDKYTE
GSYLSENLPNVADVLVEKVSKSRRLENVLHYFPNEKKNGLFGNFIALALGLQPNFKTNFKLSEDAK
LQFSKDTYDEDLEELLGKIGDDYADLFVAAKNLYDAILLSGILTVTDPTTKAPLSASMIDRYEKHQ
KDLALLKNLIKKNLTQEKYDEVFSDESKNGYAGYINGKVKQEEFYKYLKNTLSKIEGSDYFLDKIE
REDFLRKQRTFDNGSIPHQIHLQEMNAIIRRQGEHYPFLKENKEKIEKILTFRIPYYVGPLARGNRDF
AWLTRNSDQAIRPWNFEEIVDQASSAEDFINKMTNYDLYLPEEKVLPKHSLLYETFAVYNELTKVK
FIAEGLRDYQFLDSGQKQQIVNQLFKEKRKVTEKDIIQYLHNVDGYDGIELKGIEKQFNASLSTYHD
LLKIIKDKEFMDDPKNEEILENIVHTLTIFEDREMIKQRLAQYDSLFDEKVIKALTRRHYTGWGKLS
AKLINGIYDKQSKKTILDYLIDDGEINRNFMQLINDDGLSFKDIIQKAQVVGKTNDVKQVVQELPGS
PAIKKGILQSIKLVDELVKIMGHAPESIVIEMARENQTTARGKKNSQQRYKRIEDALKNLAPGLDSN
ILKENPTDNIQLQNDRLFLYYLQNGKDMYTGEALDINQLSNYDIDHIVPQAFIKDDSLDNRVLTSSK
DNRGKSDNVPSIEVVQKRKAFWQQLLDSKLISERKFNNLTKAERGGLDERDKVGFIKRQLVETRQI
TKHVAQILDARFNTEVDENNQRIRKVKIITLKSNLVSNFRKEFGLYKVREINDYHHAHDAYLNAVV
AKAILKKYPKLEPEFVYGDYQKYDLKRYISRSKDPKDIEKATEKYFFYSNLLNFFKEEVHYADGTII
KRENIEYSNDTGEIAWNKEKDFAIVRKVLSCPQVNIVKKTEVQTGGFSKESILPKRNSDKLIPRKKD
WDPKKYGGFDSPTVAYSVLVVAKVEKGKSKKLKSVKELVGITIMERSSFEKDPVDFLEAKGYKEV
RKDLIIKLPKYSLFELENGRKRMLASAGELQKGNELALPSKYVNFLYLASHYEKLKGSPEDNEQKQ |

| SEQ ID NO | Nuclease Sequence |
|---|---|
| | LFVEQHKHYLDEIIEQISEFSERVILADANLDKVLSAYNNHRDKPIREQAENIIHLFTLTNLGAPAAF<br>KFFDTTIDRKRYTSTKEILNATLIHQSITGLYETRIDLSQLGGD |
| 210 | MNKPYSIGLDIGTNSVGWSVVDDDYKVPAKKMRVFGDTDKGHIKKNLLGTLLFDSGETAESRRLK<br>RTARRRYTRRRNRILYLQEIFAKEMAKVDESFFHRLDESFLTDDDKTFDSHPIFGNKAEEDAYHQQ<br>FPTIYHLRKHLADSTEKADLRLVYLALAHMIKFRGHFLIEGELNAENTDVQKLFADFVGVYDRTFD<br>DSHLSEITVDASSILTEKISKSRRLEKLIKHYPTEKKNTLFGNLVALALGLQPNFKTNFKLSEDAKLQ<br>FSKDTYEEDLEELLGKIGDDYADLFTSAKNLYDAILLSGILTVDDESTKAPLSASMIKRYAEHHEDL<br>EKLKEFVKANKPELYHDIFKDESKNGYAGYIENGVKQDEFYKYLKETLSKQDGSQYFLDKIEREDF<br>LRKQRTFDNGSIPHQLHLKEMRSILHRQGEYYPFLKENQAKIEKILTFRIPYYVGPLARKDSRFAWA<br>EYHSDEPITPWNFDEVVDKEKSAEKFITRMTLNDLYLPEEKVLPKHSHVYETYTVYNELTKVKYV<br>NEQGEAKFFDANMKQEIFDHVFKENRKVTKDKLMDFLGKEFDEFRIVDITGLDKENKAFNASLGT<br>YHDLKKILDKSFLDDKENETIIEDIIQTLTLFEDRDMIRQRLQKYSDIFTPQQLKKLERRHYTGWGRL<br>SYKLINGIRDKQTGKTILDYLIDDGYANRNFMQLINDDTLPFKEIIQKAQIIGDIDDIKAVVHDLPGSP<br>AIKKGILQSVKIVDELVKVMGHNPDNIVIEMARENQTTNRGRTQSQQRLKKLQESLKELGSNILNE<br>KKPSYVEDKVENTHLQNDRLFLYYIQNGKDMYTGDELDIDHLSDYDIDHIIPQAFIKDDSIDNRVLT<br>SSAKNRGKSDDVPSIEIVRDRKADWMRLRKAGLISKRKFDNLTKAERGGLTEADKAGFIKRQLVET<br>RQITKHVAQILDSRENTERDENDKVIREVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEIKLANGE<br>IRKRPLIETNEETGEIVWNKEKDFATVRKVLSCPQVNIVKKTEVQTGGFSKESILPKRNSDKLIARKK<br>DWDPKKYGGFDSPTVAYSVLVVAKVEKGKSKKLKSVKELLGITIMERSSFEKNPIDFLEAKGYKEV<br>RKDLIIKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDATLIHQSITGLYETRIDLSQLGGD |
| 211 | MKKPYSIGLDIGTNSVGWAVVTDDYKVPAKKMKVLGDTDRSHIKKNLLGALLFDSGETAEGRRL<br>KRTARRRYTRRRNRILYLQEIFAEEMNKVDESFFHRLDDSFLVPEDKRGSKYPIFATLEEEKEYHKQ<br>FPTIYHLRKKLAESNEKADLRLIYLALAHMIKYRGHFLIDDPKFKVQNNDIQGLFEKFVEEYDNVQ<br>ETSLSKIKLNVTEILTAKIPKSEKQEQLLKNYPSEKKNTLFGNLIGLALGLTPNFKTIPKLSLENDAKLQI<br>SSESYEEDLGNLLALIGENFIELFSAVKNLSDGILLAGIVSDESPHAPLSTKMVIRFKEHEEDLAALK<br>HFIKSNLPEKYDEVFSDDSKNGYAGYVGVDSKVRKRNGKLATEEEFYKYLKDILNNVKGADYFLE<br>KIKREDFLRKQRTFDNGVIPYQVHLTEMKAILQHQGEYYPFLQENKEKIQQILTFRIPYYVGPLARG<br>NRDFAWLTRNSDQAIRPWNFEEVVDQASSAEDFINKMTNYDLYLPEEKVLPKHSLLYETFAVYNE<br>LTKVKFIAEGLRDYQFLDSGQKKQIVNQLFKEKRKVTEKDIIHYLHNVDGYDGIELKGIEKQFNASL<br>STYHDLLKIIKDKEFMDDPKNEEILENIVHTLTIFEDREMIKQRLAQYDSLFDEKVIKALTRRHYTG<br>WGKLSAKLINGICDKQTGDTILDYLIDDDKINRNFMQLINDDGLSFKEIIQKAQVVGKTDDVKQVV<br>QELPGSPAIKKGILQSIKLVDELVKVMGHAPESVRIEMARENQTTARGKKNSQQRYKRIEDALKNL<br>APGLDSNILKEHPTDNIQLQNDRLFLYYLQNGRDMYTGEPLDINQLSNYDIDHVPQAFIKDDSLDN<br>RVLTSSKDNRGKSDNVPSLEVVQKRKAFWQQLLDSKLISERKENNLTKAERGGLDERDKVGFIKR<br>QLVETRQITKHVAQILDARFNTEVNEKNQKIRKVKIITLKSNLVSNFRKEFGLYKVREINDYHHAHD<br>AYLNAVVAKAILKKYPKLEPEFVYGDYQKYDLKRYISRSKDPKEIEKATEKYFFYSNLLNFFKEEV<br>HYADGTIIKRENIEYSKDTGEIAWNKEKDFATVRKVLSCPQVNIVKKTEVQTGGFSKESILPKRNSD<br>KLIARKKDWDPKKYGGFDSPTVAYSVLVVAKVEKGKSKKLKSVKELLGITIMERSSFEKNPIDFLE<br>AKGYKEVRKDLIIKLPKYSLFELENGRKRMLASAGELQKGNELALPSKYVNFLYLASHYEKLKGSP<br>EDNEQKQLFVEQHKHYLDEIIEQISEFSKRVILADANLDKVLSAYNKHRDKPIREQAENIIHLFTLTN<br>LGAPAAFKYFDTTIDRKRYTSTKEVLDATLIHQSITGLYETRIDLSQLGGD |
| 212 | MKKSYSIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHMIKFRGHFLIEGGLNAENTDVQTLFNDFVEVYDKTVE<br>ESHLSEITVDALSILTEKVSKSRRLENLVKCYPTEKKNTLFGNLIALSLGLQPNFKTNFKLSEDAKLQ<br>FSKDTYEEDLEELLGKIGDEYADLFASAKNLYDAILLSGILTVDDNTTKAPLSASMVKRYAEHHED<br>LEKLKEFVKANKPELYHDIFKDETKNGYAGYIENGVKQDEFYKYLKNTLSKIAGSDYFLDKIERED<br>FLRKQRTFDNGSIPHQIHLQEMHAILRRQGEYYPFLKENQAIKEKILTFRIPYYVGPLARKNSRFAW<br>AEYHSDEKITPWNFEEIVDKEESATAFIHRMTNNDLYLPEEKVLPKHSLIYEEFTVYNELTKVKYVT<br>DQGKAYYFDANMKQEIFDGVFKEHRKVTKDKLMNFLEKEFDEFRIVDLTGLDKENKSFNASLGTY<br>HDLKKILDKSFLDDKTNETIIEDIIQTLTLFEDRDMIRQRLQKYSDIFTPQQLKKLERRHYTGWGRLS<br>YKLINGIRNKENGKTILDYLIDDGYANRNFMQLINDDTLPFKQIIQEAQIIGDIDDIETVVHDLPGSPA<br>IKKGILQSVKIVDELVKVMGHNPDNIVIEMARENQTTNRGRSQSQQRLKKLQESLKELGSNILNEEK<br>PSYVEDKVENSHLQNDKLFLYYIQNGKDMYTGEELDIDHLSDYDIDHIIPQAFIKDNSIDNRVLTSS<br>AKNRGKSDDVPSLDIVHDRKADWIRLYKSGLISKRKFDNLTKAEHGGLTEDDKAGFIKRQLVETR<br>QITKHVAQILDSRENTERDENDKVIRDVKVITLKSNLVSQFRKDFELHKVREINDYHHAHDAYLNA<br>VIGNALLVKYPQLEPEFVYGKHFHGHKENKATAKKFFYSNIMALFKKDVEYSDDTGEMVMNK<br>EKDFATVRKVLSCPQVNIVKKTEVQTGGFSKESILPKRNSDKLIARKKDWDPKKYGGFDSPTVAYS<br>VLVVAKVEKGKSKKLKSVKELGITIMERSSFEKDPVDFLEAKGYKEVRKDLIIKLPKYSLFELENG<br>RKRMLASAGELQKGNELALPSKYVNFLYLASHYEKLKGSPEDNEQKQLFVEQHKHYLDEIIEQISE<br>FSKRVILADANLDKVLSAYNKHRDKPIREQAENIIHLFTLTNLGAPAAFKYFDTTIDRKRYTSTKEV<br>LDATLIHQSITGLYETRIDLSQLGGD |
| 213 | MNKPYSIGLDIGTNSVGWSVVDDDYKVPAKKMRVFGDTDKGHIKKNLLGTLLFDSGETAESRRLK<br>RTARRRYTRRRNRILYLQEIFAKEMAKVDESFFHRLDESFLTDDDKTFDSHPIFGNKAEEDAYHQQ<br>FPTIYHLRKHLADSTEKADLRLVYLALAHMIKFRGHFLIEGELNAENTDVQKLFADFVGVYDRTFD<br>DSHLSEITVDASSILTEKISKSRRLEKLIKHYPTEKKNTLFGNLVALALGLQPNFKTNFKLSEDAKLQ<br>FSKDTYEEDLEELLGKIGDDYADLFTSAKNLYDAILLSGILTVDDESTKAPLSASMIKRYAEHHEDL |

| SEQ ID NO | Nuclease Sequence |
|---|---|
| | EKLKEFVKANKPELYHDIFKDESKNGYAGYIENGVKQDEFYKYLKETLSKQDGSQYFLDKIEREDF<br>LRKQRTFDNGSIPHQLHLKEMRSILHRQGEYYPFLKENQAKIEKILTFRIPYYVGPLARKDSRFAWA<br>EYHSDEPITPWNFDEVVDKEKSAEKFITRMTLNDLYLPEEKVLPKHSHVYETYTVYNELTKVKYV<br>NEQGEAKFFDANMKQEIFDHVFKENRKVTKDKLMDFLGKEFDEFRIVDITGLDKENKAFNASLGT<br>YHDLKKILDKSFLDDKENETIIEDIIQTLTLFEDRDMIRQRLQKYSDIFTPQQLKKLERRHYTGWGRL<br>SYKLINGIRDKQTGKTILDYLIDDGYANRNFMQLINDDTLPFKEIIQKAQIIGDIDDIKAVVHDLPGSP<br>AIKKGILQSVKIVDELVKVMGHNPDNIVIEMARENQTTNRGRTQSQQRLKKLQESLKELGSNILNE<br>KKPSYVEDKVENTHLQNDRLFLYYIQNGKDMYTGDELDIDHLSDYDIDHIIPQAFIKDDSIDNRVLT<br>SSAKNRGKSDDVPSIEIVRDRKADWMRLRKAGLISKRKFDNLTKAERGGLTEADKAGFIKRQLVET<br>RQITKHVAQILDSRENTERDENDKVIREVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEIKLANGE<br>IRKRPLIETNEETGEIVWNKEKDFATVRKVLSCPQVNIVKKTEVQTGGFSKESILPKRNSDKLIARKK<br>DWDPKKYGGFDSPTVAYSVLVVAKVEKGKSKKLKSVKELVGITIMERSSFEKNPIDFLEAKGYKE<br>VRKDLIIKLPKYSLFELENGRKRMLASAGELQKGNELALPSKYVNFLYLASHYEKLKGSPEDNEQK<br>QLFVEQHKHYLDEIIEQISEFSKRVILADANLDKVLSAYNKHRDKPIREQAENIIHLFTLTNLGAPAA<br>FKYFDTTIDRKRYTSTKEVLDATLIHQSITGLYETRIDLSQLGGD |
| 214 | MKKPYSIGLDIGTNSVGWAVVTDDYKVPAKKMRVLGDTDRSHIKKNLIGALLFDAGNTAEDRRL<br>KRTARRRYTRRRNRILYLQEIFAEEMNKVDESFFHRLDDSFLVPEDKRGSKYPIFATLQEEKEYHKQ<br>FPTIYHLRKQLAESNEKADLRLIYLALAHMIKYRGHFLIDDPKFKVQNNDIQGLFEKFVEEYDNVQ<br>ETSLSKIKLNVTEILTANIPKSEKQEQLLKNYPSEKKNTLFGNLIGLALGLTPNFKTNFSLENDAKLQI<br>SSESYEEDLGNLLALIGENFIELFSAVKNLSDGILLAGIVSDESPHAPLSTKMVIRFKEHEEDLAALK<br>HFIKANLPEKYDEVFSDDSKNGYAGYVGVDSKVRKRNGKLATEEEFYKYLKDILNNVKGADYFLE<br>KIKREDFLRKQRTFDNGTIPYQVHLTEMRAILHRQGEYYPFLQENKEKIEKILTFRIPYYVGPLARG<br>NRDFAWLTRNSDQAIRPWNFEEIVDQASSAEDFINKMTNYDLYLPEEKVLPKHSLLYETFAVYNEL<br>TKVKFIAEGLRDYQFLDSGQKKQIVNQLFKEKRKVTEKDIIQYLHNVDGYDGIELKGIEKQFNASLS<br>TYHDLLKIIKDKEFMDDPKNEEILENIVHTLTIFEDREMIKQRLAQYDSLFDEKVVKALARRHYTG<br>WGKLSAKLINGIYDKQSKKTILDYLIDDGKINRNFMQLINDDGLSFKEIIQKAQVVGKTDDVKQVV<br>QELPLGSPAIKKGILQSIKIVDELVKVMGHAPESIVIEMARENQTTARGKKNSQQRYKIRIEDALKNLA<br>PGLDSNILKEHPTDNIQLQNDRLFLYYLQNGKDMYTGEPLDINQLSSYDIDHIVPQAFIKDDSLDNR<br>VLTSSSKDNRGKSDNVPSLEVVQKRKAFWQQLLDSKLISERKENNLTKAERGGLDERDKVGFIRRQ<br>LVETRQITKHVAQILDARFNTEVNEKNQKIRTVKIITLKSNLVSNFRKEFGLYKVREINDYHHAHDA<br>YLNAVLAKAILKKYPKLEPEFVYGDYQKYDLKRYISRSRDPKEIEKATEKYFFYSNLLNFFKEEVH<br>YADGTIIKRENIEYSKDTGEIAWNKEKDFATVRKVLSCPQVNIVKKTEVQTGGFSKESILPKRNSDK<br>LIPRKTEWDPKKYGGFDSPTVAYSVLVVAKVEKGKSKKLKSVKELVGITIMERSSFEKDPVDFLEA<br>KGYKEVRKDLIIKLPKYSLFELENGRRRLLASAGELQKGNELALPSKYVNFLYLASHYEKLKGSPE<br>DNEQKQLFVEQHKHYLDEIVEQISEFSERVILADANLDKVLSAYNKNRDRPIREQAENIIHLFTLTNL<br>GAPAAFKFFDTTIDRKRYTSTKEVLDATLIHQSITGLYETRIDLSQLGGD |
| 215 | MNKPYSIGLDIGTNSVGWSVVDDDYKVPAKKMRVFGDTDKGHIKKNLLGTLLFDSGETAESRRLK<br>RTARRRYTRRRNRILYLQEIFAKEMAKVDESFFHRLDESFLTDDDKTFDSHPIFGNKAEEDAYHQQ<br>FPTIYHLRKHLADSTEKADLRLVYLALAHMIKFRGHFLIEGELNAENTDVQKLFADFVGVDRTFD<br>DSHLSEITVDASSILTEKISKSRRLEKLIKHYPTEKKNTLFGNLVALALGLQPNFKTNFKLSEDAKLQ<br>FSKDTYEEDLEELLGKIGDDYADLFTSAKNLYDAILLSGILTVDDESTKAPLSASMIKRYAEHHEDL<br>EKLKEFVKANKPELYHDIFKDESKNGYAGYIENGVKQDEFYKYLKETLSKQDGSQYFLDKIEREDF<br>LRKQRTFDNGSIPHQLHLKEMRSILHRQGEYYPFLKENQAKIEKILTFRIPYYVGPLARKDSRFAWA<br>EYHSDEPITPWNFDEVVDKEKSAEKFITRMTLNDLYLPEEKVLPKHSHVYETYTVYNELTKVKYV<br>NEQGEAKFFDANMKQEIFDHVFKENRKVTKDKLMDFLGKEFDEFRIVDITGLDKENKAFNASLGT<br>YHDLKKILDKSFLDDKENETIIEDIIQTLTLFEDRDMIRQRLQKYSDIFTPQQLKKLERRHYTGWGRL<br>SYKLINGIRDKQTGKTILDYLIDDGYANRNFMQLINDDTLPFKEIIQKAQIIGDIDDIKAVVHDLPGSP<br>AIKKGILQSVKIVDELVKVMGHNPDNIVIEMARENQTTNRGRTQSQQRLKKLQESLKELGSNILNE<br>KKPSYVEDKVENTHLQNDRLFLYYIQNGKDMYTGDELDIDHLSDYDIDHIIPQAFIKDDSIDNRVLT<br>SSAKNRGKSDDVPSIEIVRDRKADWMRLRKAGLISKRKFDNLTKAERGGLTEADKAGFIKRQLVET<br>RQITKHVAQILDSRENTERDENDKVIREVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEIKLANGE<br>IRKRPLIETNEETGEIVWNKEKDFATVRKVLSCPQVNIVKKTEVQTGGFSKESILPKRNSDKLIPRKT<br>EWDPKKYGGFDSPTVAYSVLVVAKVEKGKSKKLKSVKELVGITIMERSSFEKDPVDFLEAKGYKE<br>VRKDLIIKLPKYSLFELENGRRRLLASAGELQKGNELALPSKYVNFLYLASHYEKLKGSPEDNEQK<br>QLFVEQHKHYLDEIVEQISEFSERVILADANLDKVLSAYNKNRDRPIREQAENIIHLFTLTNLGAPAA<br>FKFFDTTIDRKRYTSTKEVLDATLIHQSITGLYETRIDLSQLGGD |
| 216 | MKKPYSIGLDIGTNSVGWAVVTDDYKVPAKKMKVLGDTDKSHIKKNLLGTLLFESGETAEGRRLK<br>RTARRRYTRRRNRILYLQEIFAEEMNKVDDSFFQRLDESFLKDDDKNFDSHPIFGNKAEEDAYHQK<br>FPTIYHLRQYLADSPEKADLRLVYLALAHIIKYRGHFLFEGDLKSENKDVQHLFNDFVEMFDKTVE<br>GSYLSENLPNVADVLVEKVSKSRRLENVLHYFPNEKKNGLFGNFIALALGLQPNFKTNFKLSEDAK<br>LQFSKDTYDEDLEELLGKIGDDYADLFVAAKNLYDAILLSGILTVTDPTTKAPLSASMIDRYEKHH<br>KDLALLKNLIKQNLTQEKYDEVFSDESKNGYAGYISGKVKQEEFYKYLKNTLSKIEGSDYFLDKIE<br>REDFLRKQRTFDNGSIPHQIHLQEMNAIIRRQGEHYPFLKENKEKIEKILTFRIPYYVGPLARGNRDF<br>AWLTRNSDQAIRPWNFEEIVDQASSAEDFINKMTNYDLYLPEEKVLPKHSLLYETFAVYNELTKVK<br>FIAEGLRDYQFLDSGQKKQIVNQLFKEKRKVTEKDIIQYLHNVDGYDGIELKGIEKQFNASLSTYHD<br>LLKIIKDKEFMDDPKNEEILENIVHTLTIFEDREMIKQRLAQYDSLFDEKVIKALTRRHYTGWGKLS<br>AKLINGIYDKQSKKTILDYLIDDGEINRNFMQLINDDGLSFKDIIQKAQVVGKTNDVKQVVQELPGS<br>PAIKKGILQSIKLVDELVKVMGHAPESIVIEMARENQTTARGKKNSQQRYKIRIEDALKNLAPGLDS<br>NILKENPTDNIQLQNDRLFLYYLQNGKDMYTGEALDINQLSNYDIDHIVPQAFIKDDSLDNRVLTSS |

| SEQ ID NO | Nuclease Sequence |
|---|---|
| | KDNRGKSDNVPSIEVVQKRKAFWQQLLDSKLISERKENNLTKAERGGLDERDKVGFIKRQLVETR<br>QITKHVAQILDARFNTEVDENNQRIRKVKIITLKSNLVSNFRKEFGLYKVREINDYHHAHDAYLNA<br>VVAKAILKKYPKLEPEFVYGDYQKYDLKRYISRSKDPKDIEKATEKYFFYSNLLNFFKEEVHYADG<br>TIIKRENIEYSNDTGEIAWNKEKDFATVRKVLSCPQVNIVKKTEVQTGGFSKESILPKRNSDKLIARK<br>KDWDPKKYGGFDSPTVAYSVLVVAKVEKGKSKKLKSVKELVGITIMERSSFEKNPIDFLEAKGYK<br>EVRKDLIIKLPKYSLFELENGRKRMLASAGELQKGNELALPSKYVNFLYLASHYEKLKGSPEDNEQ<br>KQLFVEQHKHYLDEIIEQISEFSKRVILADANLDKVLSAYNKHRDKPIREQAENIIHLFTLTNLGAPA<br>AFKYFDTTIDRKYTSTKEVLDATLIHQSITGLYETRIDLSQLGGD |
| 217 | MKKPYSIGLDIGTNSVGWAVVTDDYKVPAKKMKVLGDTDKSHIKKNLLGTLLFESGETAEGRRLK<br>RTARRRYTRRRNRILYLQEIFAEEMNKVDDSFFQRLDESFLKDDDKNFDSHPIFGNKAEEDAYHQK<br>FPTIYHLRQYLADSPEKADLRLVYLALAHIIKYRGHELFEGDLKSENKDVQHLFNDFVEMEDKTVE<br>GSYLSENLPNVADVLVEKVSKSRRLENVLHYFPNEKKNGLFGNFIALALGLQPNFKTNFKLSEDAK<br>LQFSKDTYDEDLEELLGKIGDDYADLFVAAKNLYDAILLSGILTVTDPTTKAPLSASMIDRYEKHH<br>KDLALLKNLIKQNLTQEKYDEVFSDESKNGYAGYISGKVKQEEFYKYLKNTLSKIEGSDYFLDKIE<br>REDFLRKQRTFDNGSIPHQIHLQEMNAIIRRQGEHYPFLKENKEKIEKILTFRIPYYVGPLARGNRDF<br>AWLTRNSDQAIRPWNFEEIVDQASSAEDFINKMTNYDLYLPEEKVLPKHSLLYETFAVYNELTKVK<br>FIAEGLRDYQFLDSGQKKQIVNQLFKEKRKVTEKDIIQYLHNVDGYDGIELKGIEKQFNASLSTYHD<br>LLKIIKDKEFMDDPKNEEILENIVHTLTIFEDREMIKQRLAQYDSLFDEKVIKALTRRHYTGWGKLS<br>AKLINGIYDKQSKKTILDYLIDDGEINRNFMQLINDDGLSFKDIIQKAQVVGKTNDVKQVVQELPGS<br>PAIKKGILQSIKLVDELVKVMGHAPESIVIEMARENQTTARGKKNSQQRYKRIEDALKNLAPGLDS<br>NILKENPTDNIQLQNDRLFLYYLQNGKDMYTGEALDINQLSNYDIDHIVPQAFIKDDSLDNRVLTSS<br>KDNRGKSDNVPSIEVVQKRKAFWQQLLDSKLISERKENNLTKAERGGLDERDKVGFIKRQLVETR<br>QITKHVAQILDARFNTEVDENNQRIRKVKIITLKSNLVSNFRKEFGLYKVREINDYHHAHDAYLNA<br>VVAKAILKKYPKLEPEFVYGDYQKYDLKRYISRSKDPKDIEKATEKYFFYSNLLNFFKEEVHYADG<br>TIIKRENIEYSNDTGEIAWNKEKDFATVRKVLSCPQVNIVKKTEVQTGGFSKESILPKRNSDKLIARK<br>KDWDPKKYGGFDSPTVAYSVLVVAKVEKGKSKKLKSVKELVGITIMERSSFEKDPVDFLEAKGYK<br>EVRKDLIIKLPKYSLFELENGRKRMLASAGELQKGNELALPSKYVNFLYLASHYEKLKGSPEDNEQ<br>KQLFVEQHKHYLDEIIEQISEFSKRVILADANLDKVLSAYNKHRDKPIREQAENIIHLFTLTNLGAPA<br>AFKYFDTTIDRKYTSTKEVLDSTLIHQSITGLYETRIDLSQLGGD |
| 218 | MNKPYSIGLDIGTNSVGWSVVDDDYKVPAKKMRVFGDTDKGHIKKNLLGTLLFDSGETAESRRLK<br>RTARRRYTRRRNRILYLQEIFAKEMAKVDESFFHRLDESFLTDDKTFDSHPIFGNKAEEDAYHQQ<br>FPTIYHLRKHLADSTEKADLRLVYLALAHMIKFRGHFLIEGELNAENTDVQKLFADFVGVYDRTFD<br>DSHLSEITVDASSILTEKISKSRRLEKLIKHYPTEKKNTLFGNLVALALGLQPNFKTNFKLSEDAKLQ<br>FSKDTYEEDLEELLGKIGDDYADLFTSAKNLYDAILLSGILTVDDESTKAPLSASMIKRYAEHHEDL<br>EKLKEFVKANKPELYHDIFKDESKNGYAGYIENGVKQDEFYKYLKETLSKQDGSQYFLDKIEREDF<br>LRKQRTFDNGSIPHQLHLKEMRSILHRQGEYYPFLKENQAKIEKILTFRIPYYVGPLARKDSRFAWA<br>EYHSDEPITPWNFDEVVDKEKSAEKFITRMTLNDLYLPEEKVLPKHSHVYETYTVYNELTKVKYV<br>NEQGEAKFFDANMKQEIFDHVFKENRKVTKDKLMDFLGKEFDEFRIVDITGLDKENKAFNASLGT<br>YHDLKKILDKSFLDDKENETIIEDIIQTLTLFEDRDMIRQRLQKYSDIFTPQQLKKLERRHYTGWGRL<br>SYKLINGIRDKQTGKTILDYLIDDGYANRNFMQLINDDTLPFKEIIQKAQIIGDIDDIKAVVHDLPGSP<br>AIKKGILQSVKIVDELVKVMGHNPDNIVIEMARENQTTNRGRTQSQQRLKKLQESLKELGSNILNE<br>KKPSYVEDKVENTHLQNDRLFLYYIQNGKDMYTGDELDIDHLSDYDIDHIIPQAFIKDDSIDNRVLT<br>SSAKNRGKSDDVPSIEIVRDRKADWMRLRKAGLISKRKFDNLTKAERGGLTEADKAGFIKRQLVET<br>RQITKHVAQILDSRENTERDENDKVIREVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEIKLANGE<br>IRKRPLIETNEETGEIVWNKEKDFATVRKVLSCPQVNIVKKTEVQTGGFSKESILPKRNSDKLIARKK<br>DWDPKKYGGFDSPTVAYSVLVVAKVEKGKSKKLKSVKELVGITIMERSSFEKDPIDFLEAKGYKE<br>VRKDLIIKLPKYSLFELENGRKRMLASAGELQKGNELALPSKYVNFLYLASHYEKLKGSPEDNEQK<br>QLFVEQHKHYLDEIIEQISEFSKRVILADANLDKVLSAYNKHRDKPIREQAENIIHLFTLTNLGAPAA<br>FKYFDTTIDRKYTSTKEVLDATLIHQSITGLYETRIDLSQLGGD |
| 219 | MKKSYSIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHMIKFRGHFLIEGQLSAENTNVQTLFNDFVEVYDKTVE<br>ESHLSEITIDALSILTEKVSKSRRLENLVKCYPTEKKNTLFGNLIALSLGLQPNFKTNFKLSEDAKLQF<br>SKDTYEEDLEELLGKIGDEYADLFASAKNLYDAILLSGILTVDDSTKAPLSASMVKRYAEHHEDL<br>EKLKEFVKANKPELYHDIFKDETKNGYAGYIENGVKQDEFYKYLKNTLSKIAGSDYFLDKIEREDF<br>LRKQRTFDNGSIPHQIHLQEMHAILRRQGEYYPFLKENQAKIEKILTFRIPYYVGPLARKNSRFAWA<br>EYHSDEKITPWNFEEIVDKEESATAFIHRMTNNDLYLPEEKVLPKHSLIYEEFTVYNELTKVKYVTD<br>QGKAYYFDANMKQEIFDGVFKEHRKVTKDKLMNFLEKEFDEFRIVDLTGLDKENKSFNASLGTYH<br>DLKKILDKSFLDDKTNETIIEDIIQTLTLFEDRDMIRQRLQKYSDIFTPQQLKKLERRHYTGWGRLSY<br>KLINGIRNKENRKTILDYLIDDGYANRNFMQLINDDTLPFKQIIQEAQIIGDIDDIETVVHDLPGSPAI<br>KKGILQSVKIVDELVKVMGHNPDNIVIEMARENQTTNRGRSQSQQRLKKLQESLKELGSNILNEEK<br>PSYVEDKVENSHLQNDKLFLYYIQNGKDMYTGEELDIDHLSDYDIDHIIPQAFIKDNSIDNRVLTSS<br>AKNRGKSDDVPSLDIVHDRKADWIRLYKSGLISKRKFDNLTKAEHGGLTEDDKAGFIKRQLVETR<br>QITKHVAQILDSRENTERDENDKVIRDVKVITLKSNLVSQFRKDFELHKVREINDYHHAHDAYLNA<br>VIGNALLVKKYPQLEPEFVYGKFSHFHGHKENKATAKKFFYSNIMALFKKDVEYSDDTGEMVWNK<br>EKDFATVRKVLSCPQVNIVKKTEVQTGGFSKESILPKRNSDKLIPRKKDWDPKKYGGFDSPTVAYS<br>VLVVAKVEKGKSKKLKPVKELIGITIMERSSFEKDPIDFLEAKGYKEVRKDLIIKLPKYSLFELENGR<br>KRMLASAGELQKGNELALPSKYVNFLYLASHYEKLKGSPEDNEQKQLFVEQHKHYLDEIIEQISEF<br>SERVILADANLDKVLSAYNKHRDKPIREQAENILHLFTLTNLGAPAAFKFFDTTIDRKYTSTKEVL<br>DATLIHQSITGLYETRIDLSQLGGD |

| SEQ ID NO | Nuclease Sequence |
|---|---|
| 220 | MNKPYSIGLDIGTNSVGWSVVDDDYKVPAKKMRVFGDTDKGHIKKNLLGTLLFDSGETAESRRLK<br>RTARRRYTRRRNRILYLQEIFAKEMAKVDESFFHRLDESFLTDDDKTFDSHPIFGNKAEEDAYHQQ<br>FPTIYHLRKHLADSTEKADLRLVYLALAHMIKFRGHFLIEGELNAENTDVQKLFADFVGVYDRTFD<br>DSHLSEITVDASSILTEKISKSRRLEKLIKHYPTEKKNTLFGNLVALALGLQPNFKTNFKLSEDAKLQ<br>FSKDTYEEDLEELLGKIGDDYADLFTSAKNLYDAILLSGILTVDDESTKAPLSASMIKRYAEHHEDL<br>EKLKEFVKANKPELYHDIFKDESKNGYAGYIENGVKQDEFYKYLKETLSKQDGSQYFLDKIEREDF<br>LRKQRTFDNGSIPHQLHLKEMRSILHRQGEYYPFLKENQAKIEKILTFRIPYYVGPLARKDSRFAWA<br>EYHSDEPITPWNFDEVVDKEKSAEKFITRMTLNDLYLPEEKVLPKHSHVYETYTVYNELTKVKYV<br>NEQGEAKFFDANMKQEIFDHVFKENRKVTKDKLMDFLGKEFDEFRIVDITGLDKENKAFNASLGT<br>YHDLKKILDKSFLDDKENETIIEDIIQTLTLFEDRDMIRQRLQKYSDIFTPQQLKKLERRHYTGWGRL<br>SYKLINGIRDKQTGKTILDYLIDDGYANRNFMQLINDDTLPFKEIIQKAQIIGDIDDIKAVVHDLPGSP<br>AIKKGILQSVKIVDELVKVMGHNPDNIVIEMARENQTTNRGRTQSQQRLKKLQESLKELGSNILNE<br>KKPSYVEDKVENTHLQNDRLFLYYIQNGKDMYTGDELDIDHLSDYDIDHIIPQAFIKDDSIDNRVLT<br>SSAKNRGKSDDVPSIEIVRDRKADWMRLRKAGLISKRKFDNLTKAERGGLTEADKAGFIKRQLVET<br>RQITKHVAQILDSRENTERDENDKVIREVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEIKLANGE<br>IRKRPLIETNEETGEIVWNKEKDFATVRKVLSCPQVNIVKKTEVQTGGFSKESILPKRNSDKLIPRKK<br>GWDPKKYGGFDSPTVAYSVLVVAKVEKGKSKKLKSVKELVGITIMERSSFEKDPVDFLEAKGYKE<br>VRKDLIIKLPKYSLFELENGRKRMLASAGELQKGNELALPSKYVNFLYLASHYEKLKGSPEDNEQK<br>QLFVEQHKHYLDEIVEQISEFSERVILADANLDKVLSAYNKNRDRPIREQAENIIHLFTLTNLGAPAA<br>FKFFNTDIDRKRYTSTKEILDATLIHQSITGLYETRIDLSQLGGD |
| 221 | MNKPYSIGLDIGTNSVGWSVVDDDYKVPAKKMRVFGDTDKGHIKKNLLGTLLFDSGETAESRRLK<br>RTARRRYTRRRNRILYLQEIFAKEMAKVDESFFHRLDESFLTDDDKTFDSHPIFGNKAEEDAYHQQ<br>FPTIYHLRKHLADSTEKADLRLVYLALAHMIKFRGHFLIEGELNAENTDVQKLFADFVGVYDRTFD<br>DSHLSEITVDASSILTEKISKSRRLEKLIKHYPTEKKNTLFGNLVALALGLQPNFKTNFKLSEDAKLQ<br>FSKDTYEEDLEELLGKIGDDYADLFTSAKNLYDAILLSGILTVDDESTKAPLSASMIKRYAEHHEDL<br>EKLKEFVKANKPELYHDIFKDESKNGYAGYIENGVKQDEFYKYLKETLSKQDGSQYFLDKIEREDF<br>LRKQRTFDNGSIPHQLHLKEMRSILHRQGEYYPFLKENQAKIEKILTFRIPYYVGPLARKDSRFAWA<br>EYHSDEPITPWNFDEVVDKEKSAEKFITRMTLNDLYLPEEKVLPKHSHVYETYTVYNELTKVKYV<br>NEQGEAKFFDANMKQEIFDHVFKENRKVTKDKLMDFLGKEFDEFRIVDITGLDKENKAFNASLGT<br>YHDLKKILDKSFLDDKENETIIEDIIQTLTLFEDRDMIRQRLQKYSDIFTPQQLKKLERRHYTGWGRL<br>SYKLINGIRDKQTGKTILDYLIDDGYANRNFMQLINDDTLPFKEIIQKAQIIGDIDDIKAVVHDLPGSP<br>AIKKGILQSVKIVDELVKVMGHNPDNIVIEMARENQTTNRGRTQSQQRLKKLQESLKELGSNILNE<br>KKPSYVEDKVENTHLQNDRLFLYYIQNGKDMYTGDELDIDHLSDYDIDHIIPQAFIKDDSIDNRVLT<br>SSAKNRGKSDDVPSIEIVRDRKADWMRLRKAGLISKRKFDNLTKAERGGLTEADKAGFIKRQLVET<br>RQITKHVAQILDSRENTERDENDKVIREVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEIKLANGE<br>IRKRPLIETNEETGEIVWNKEKDFATVRKVLSCPQVNIVKKTEVQTGGFSKESILPKRNSDKLIARKK<br>DWDPKKYGGFDSPTVAYSVLVVAKVEKGKSKKLKSVKELVGITIMERSSFEKDPVDFLEAKGYKE<br>VRKDLIIKLPKYSLFELENGRKRMLASAGELQKGNELALPSKYVNFLYLASHYEKLKGSPEDNEQK<br>QLFVEQHKHYLDEIIEQISEFSKRVILADANLDKVLSAYNKHRDKPIREQAENIIHLFTLTNLGAPAA<br>FKYFDTTIDRKRYTSTKEVLDSTLIHQSITGLYETRIDLSQLGGD |
| 222 | MKKPYSIGLDIGTNSVGWAVVTDDYKVPAKKMKVLGDTDKSHIKKNLLGTLLFESGETAEGRRLK<br>RTARRRYTRRRNRILYLQEIFAEEMNKVDDSFFQRLDESFLKDDDKNFDSHPIFGNKAEEDAYHQK<br>FPTIYHLRQYLADSPEKADLRLVYLALAHIIKYRGHELFEGDLKSENKDVQHLFNDFVEMEDKTVE<br>GSYLSENLPNVADVLVEKVSKSRRLENVLHYFPNEKKNGLFGNFIALALGLQPNFKTNFKLSEDAK<br>LQFSKDTYDEDLEELLGKIGDDYADLFVAAKNLYDAILLSGILTVDTDPTTKAPLSASMIDRYEKHQ<br>KDLALLKNLIKQNLTQEKYDEVFSDESKNGYAGYINGKVKQEEFYKYLKNTLSKIEGSDYFLDKIE<br>REDFLRKQRTFDNGSIPHQIHLQEMNAIIRRQGEHYPFLKENKEKIEKILTFRIPYYVGPLARGNRDF<br>AWLTRNSDQAIRPWNFEEIVDQASSAEDFINKMTNYDLYLPEEKVLPKHSLLYETFAVYNELTKVK<br>FIAEGLRDYQFLDSGQKQIVNQLFKEKRKVTEKDIIQYLHNGYDGIELKGIEKQFNASLSTYHD<br>LLKIIKDKEFMDDPKNEEILENIVHTLTIFEDREMIKQRLAQYDSLFDEKVIKALTRRHYTGWGKLS<br>AKLINGIYDKQSKKTILDYLIDDGEINRNFMQLINDDGLSFKDIIQKAQVVGKTNDVKQVVQELPGS<br>PAIKKGILQSIKLVDELVKVMGHAPESIVIEMARENQTTARGKKNSQQRYKRIEDALKNLAPGLDS<br>NILKENPTDNIQLQNDRLFLYYLQNGKDMYTGEALDINQLSYIDHIVPQAFIKDDSLDNRVLTSS<br>KDNRGKSDNVPSIEVVQKRKAFWQQLLDSKLISERKENNLTKAERGGLDERDKVGFIKRQLVETR<br>QITKHVAQILDARFNTEVDENNQRIRKVKIITLKSNLVSNFRKEFGLYKVREINDYHHAHDAYLNA<br>VVAKAILKKYPKLEPEFVYGDYQKYDLKRYISRSKDPKDIEKATEKYFFYSNLLNFFKEEVHYADG<br>TIIKRENIEYSNDTGEIAWNKEKDFAIVRKVLSCPQVNIVKKTEVQTGGFSKESILPKRNSDKLIPRK<br>NNWDPKKYGGFDSPTVAYSVLVVAKVEKGKSKKLKPVKELVGITIMERSSFEKDPVDFLEAKGYK<br>EVRKDLIIKLPKYSLFELENGRKRMLASAGELQKGNELALPSKYVNFLYLASHYEKLKGSPEDNEQ<br>KQLFVEQHKHYLDEIIEQISEFSERVILADANLDKVLSAYNHRDKPIREQAENIIHLFTLTNLGAPA<br>AFKFFDTTIDRKRYTSTKEILDATLIHQSITGLYETRIDLSKLGGD |
| 223 | MKKSYSIGLDIGTNSVGWSVVTDDYKVPAKKMKVFGNTDKKYIKKNLLGTLLFDNGETAEGRRL<br>KRTARRRYTRRRNRILYLQEIFAKEMSKIDESFFQRLEESFLTDDDKNFDSHPIFGNKAEEDAYHKQ<br>FPTIYHLRKHLADSSEKADLRLVYLALAHMIKFRGHFLIEGQLKAENTNVQTLFNDFVEVYDKTVE<br>ESHLAEITVDALSILTEKVSKSRRLENLLKYYPTEKKNTLFGNLIALSLGLQPNFKTNFKLSEDAKLQ<br>FSKDTYEEDLEELLGKIGDEYADLFTSAKNLYDAILLSGILTVDDKSTKAPLSASMLKRYVEHHEDL<br>EKLKDFVKANKPELYHDIFKDETKNGYAGYIENGVKQDEFYKYLKNTLSKIAGSDYFLDKIEREDF<br>LRKQRTFDNGSIPHQVHLQEMRAILRRQGEYYPFLKENQAKIEKILTFRIPYYVGPLARKDSRFAWA |

| SEQ ID NO | Nuclease Sequence |
|---|---|
| | EYHSDEKITPWNFDKVIDKESSARAFIEHMTNHDLYLPEEKVLPKHSPLYEKYTVYNELTKVKYVT
EQGKSSFFDANMKQEIFEHVFKKNRKVTKDKFLNYLNKEFPEYRIHDLIGLDKENKSFNASLGTYH
DLKKILDKSFLDNKENEEIIEDVVLTLTLFEDRDMIRQRLQKYSDIFTKDQLKKLERRHYTGWGRLS
YKLINGIRDKQSNKTILDYLLEDDGVKKNINRNFMQLINDDSLSFKTIIQEAQVIGDIDDIKAVVHDL
PGSPAIKKGILQSVKIVDELVKIMGHNPDNIVIEMARENQTTNRGRSQSQQRLKKLQESLKELGSNI
LNEEKPSYIEDKVENSHLQNDRLFLYYIQNGKDMYTGDELDIDHLSYDYDIDHIIPQAFIKDNSIDNRV
LTSSAKNRGKSDDVPSLDIVRERKADWIRLYKAGLISKRKFDNLTKAERGGLTENDKAGFIKRQLV
ETRQITKHVAQILDARFNTKRDENDKVIRDVKIITLKSNLVSQFRKEFGFYKIREVNDYHHAHDAYL
NAVVGTALIKKYPKLESEFVYGDYKVYDVRKMIAKSEQEIGKATAKRFFYSNIMNFFKTEIKLANG
EIRKRPLIETNEETGEVVWNKEKDFAIVRKVLSCPQVNIVKKTEVQTGAFTKESILPKRNSDKLIAR
KKNWDPKKYGGFDSPIVAYSVLVVAKVEKGKSKKLKPVKELVGITIMEQKSFEKDPIDFLEAKGY
KEVRKDLIIKLPKYSLFELENGRKRMLASAGELQKGNELALPSKYINFLYLASHYEKLKGSPEDNE
QKQLFVEQHKHYLDEIIEQISEFSERVILADANLDKVLSAYNNHRDKPIREQAENIIHLFTLTNLGAP
AAFKFFDTTIDRKRYTSTKEVLDATLIHQSITGLYETRIDLSQLGGD |
| 224 | MKKSYSIGLDIGTNSVGWAVVNDDYKVPAKKMRVFGDTDRSHIKKNLLGTLLLFDSGETAEGRRL
KRTARRRYTRRRNRILYLQEIFAEEMNKIDESFFHRLDDSFLVPEDKRGSKYPIFATLAEEKEYHKQ
FPTIYHLRKKLAESNEKADLRLVYLALAHMIKYRGHFLIDDPKFKVQNNDIQGLFEKFVEEYDNVQ
ETSLSKIKLNVTEILTANIPKSEKQEQLLKNYPSEKKNTLFGNLIGLALGLTPNFKTNFSLENDAKLQI
SSESYEEDLGNLLALIGENFIELFSAVKNLSDGILLAGIVSDESPHAPLSTKMVIRFKEHEEDLAALK
HFIKANLPEKYDEVFSDDSKNGYAGYVGVDSKVRKRNGKLATEEEFYKYLKNILNNIKGADYFLE
KIEREDLLRKQRTFDNGTIPYQVHLAEMRAILHRQGDYYPFLKENREKIEKILTFRIPYYVGPLARG
NRDFAWLTRNSDQAIRPWNFEEVVDQASSAEDFINKMTNYDLYLPEEKVLPKHSLLYETFAVYNE
LTKVKFIAEGLRDYQFLDSGQKKQIVNQLFKEKRKVTEKDIIHYLHNVDGYDGIELKGIEKQFNASL
STYHDLLKIIKDKEFMDDPKNEEILENIVHTLTIFEDREMIKQRLAQYDSLFDEKVIKALTRRHYTG
WGKLSAKLINGICDKQTGNTILDYLIDDDKINRNFMQLINDDGLSFKEIIQKAQVVGKTDDVKQVV
QELPGSPAIKKGILQSIKIVDELVKVMGHAPESIVIEMARENQTTARGKKNSQQRYKRIEDALKNLA
PGLDSNILKEHPTDNIQLQNDRLFLYYLQNGKDMYTGESLDINQLSSYDIDHIVPQAFIKDDSLDNR
VLTSSKDNRGKSDNVPSIEVVQKRKAFWQQLLDSKLISERKENNLTKAERGGLDERDKVGFIKRQL
VETRQITKHVAQILDARFNTEVNEKGQKIRKVKIITLKSNLVSNFRKEFGLYKVREINDYHHAHDA
YLNAVVAKAILKKYPKLEPEFVYGDYQKYDIKRYISKSKDPKEIEKATEKYFFYSNLLNFFKEEVH
YADGTIIKRENIEYSKDTGEIAWNKEKDFATVRKVLSCPQVNIVKKTEVQTGGFSKESILPKRNSDK
LIPRKTEWDPKKYGGFDSPIVAYSVLVVAKVEKGKSKKLKPVKELVGITIMERSSFEKDPVDFLEA
KGYKEVRKDLIIKLPKYSLFELENGRKRMLASAGELQKGNELALPSKYVNFLYLASHYEKLKGSPE
DNEQKQLFVEQHKYLDEIVEQISEFSERVILADANLDKILSAYNKHRDKPIREQAENIINLFTFTNL
GAPAAFKFFDTDIDRKRYTSTKEVLDATLIHQSITGLYETRIDLSQLGGD |
| 225 | MKKPYSIGLDIGTNSVGWAVVTDDYKVPAKKMKVLGDTDKSHIKKNLLGTLLFESGETAEGRRLK
RTARRRYTRRRNRILYLQEIFAEEMNKVDDSFFQRLDESFLKDDDKNFDSHPIFGNKAEEDAYHQK
FPTIYHLRQYLADSPEKADLRLVYLALAHIIKYRGHELFEGDLKSENKDVQHLFNDFVEMEDKTVE
GSYLSENLPNVADVLVEKVSKSRRLENVLHYFPNEKKNGLFGNFIALALGLQPNFKTNFKLSEDAK
LQFSKDSYDEDLEELLGKIGDDYADLFVAAKNLYDAILLSGILTVTDPTTKAPLSASMIDRYEKHH
KDLALLKNLIKKNLTQEKYDEVFSDESKNGYAGYINGKVKQEEFYKYLKNTLSKIEGSDYFLDKIE
REDFLRKQRTFDNGSIPHQIHLQEMNAIIRRQGEHYPFLKENKEKIEKILTFRIPYYVGPLARGNRDF
AWLTRNSDQAIRPWNFEEIVDQASSAEDFINKMTNYDLYLPEEKVLPKHSLLYETFAVYNELTKVK
FIAEGLRDYQFLDSGQKKQIVNQLFKEKRKVTEKDIIQYLHNVDGYDGIELKGIEKQFNASLSTYHD
LLKIIKDKEFMDDPKNEEILENIVHTLTIFEDREMIKQRLAQYDSLFDEKVIKALTRRHYTGWGKLS
AKLINGIYDKQSKKTILDYLIDDGEINRNFMQLINDDGLSFKDIIQKAQVVGKTNDVKQVVQELPGS
PAIKKGILQSIKLVDELVKVMGHAPESIVIEMARENQTTARGKKNSQQRYKRIEDALKNLAPGLDS
NILKENPTDNIQLQNDRLFLYYLQNGKDMYTGEALDINQLSKYDIDHIVPQAFIKDDSLDNRVLTSS
KDNRGKSDNVPSIEVVQKRKAFWQQLLDSKLISERKFNNLTKAERGGLDERDKVGFIKRQLVETR
QITKHVAQILDARFNTEVDENNQRIRKVKIITLKSNLVSNFRKEFGLYKVREINDYHHAHDAYLNA
VVAKAILKKYPKLEPEFVYGDYQKYDLKRYISRSKDPKDIEKATEKYFFYSNLLNFFKEEVHYADG
TIIKRENIEYSNDTGEIAWNKEKDFATVRKVLSCPQVNIVKKTEVQTGGFSKESILPKRNSDKLIARK
KDWDPKKYGGFDSPTVAYSVLVIAKVEKGKSKKLKPVKELVGITIMERSSFEKNPIDFLEAKGYKE
VREDLIIKLPKYSLFELENGRKRMLASAGELQKGNELALPSKYVNFLYLASHYEKLKGSPEDNEQK
RLFVEQHKYLDEIVEQISEFSERVILADANLDKILSAYNKHRDKPIREQAENIINLETLTNLGAPAA
FKFFDTTIDRKRYTSTKEILDATLIHQSITGLYETRIDLSQLGGN |
| 226 | MKKPYSIGLDIGTNSVGWAVVTDDYKVPAKKMKVLGDTDKSHIKKNLLGTLLFESGETAEGRRLK
RTARRRYTRRRNRILYLQEIFAEEMNKVDDSFFQRLDESFLKDDDKNFDSHPIFGNKAEEDAYHQK
FPTIYHLRQYLADSPEKADLRLVYLALAHIIKYRGHELFEGDLKSENKDVQHLFNDFVEMEDKTVE
GSYLSENLPNVADVLVEKVSKSRRLENVLHYFPNEKKNGLFGNFIALALGLQPNFKTNFKLSEDAK
LQFSKDTYDEDLEELLGKIGDDYADLFVAAKNLYDAILLSGILTVTDPTTKAPLSASMIDRYEKHH
KDLALLKNLIKQNLTQEKYDEVFSDESKNGYAGYISGKVKQEEFYKYLKNTLSKIEGSDYFLDKIE
REDFLRKQRTFDNGSIPHQIHLQEMNAIIRRQGEHYPFLKENKEKIEKILTFRIPYYVGPLARGNRDF
AWLTRNSDQAIRPWNFEEIVDQASSAEDFINKMTNYDLYLPEEKVLPKHSLLYETFAVYNELTKVK
FIAEGLRDYQFLDSGQKKQIVNQLFKEKRKVTEKDIIQYLHNVDGYDGIELKGIEKQFNASLSTYHD
LLKIIKDKEFMDDPKNEEILENIVHTLTIFEDREMIKQRLAQYDSLFDEKVIKALTRRHYTGWGKLS
AKLINGIYDKQSKKTILDYLIDDGEINRNFMQLINDDGLSFKDIIQKAQVVGKTNDVKQVVQELPGS
PAIKKGILQSIKLVDELVKVMGHAPESIVIEMARENQTTARGKKNSQQRYKRIEDALKNLAPGLDS
NILKENPTDNIQLQNDRLFLYYLQNGKDMYTGEALDINQLSNYDIDHIVPQAFIKDDSLDNRVLTSS
KDNRGKSDNVPSIEVVQKRKAFWQQLLDSKLISERKENNLTKAERGGLDERDKVGFIKRQLVETR
QITKHVAQILDARFNTEVDENNQRIRKVKIITLKSNLVSNFRKEFGLYKVREINDYHHAHDAYLNA |

| SEQ ID NO | Nuclease Sequence |
|---|---|
| | VVAKAILKKYPKLEPEFVYGDYQKYDLKRYISRSKDPKDIEKATEKYFFYSNLLNFFKEEVHYADG
TIIKRENIEYSNDTGEIAWNKEKDFATVRKVLSCPQVNIVKKTEVQTGGFSKESILPKRNSDKLIARK
KDWDPKKYGGFDSPTVAYSVLVVAKVEKGKSKKLKSVKELLGITIMERSSFEKNPIDFLEAKGYKE
VRKDLIIKLPKYSLFELENGRKRMLASAGELQKGNELALPSKYVNFLYLASHYEKLKGSPEDNEQK
QLFVEQHKHYLDEIIEQISEFSKRVILADANLDKVLSAYNKHRDKPIREQAENIIHLFTLTNLGAPAA
FKYFDTTIDRKRYTSTKEVLDSTLIHQSITGLYETRIDLSQLGGD |
| 227 | MKKPYSIGLDIGTNSVGWAVITDDYKVPSKKMKVLGNTNKSHIKKNLLGTLLFDSGETAEGRRLK
RTARRRYTRRRNRILYLQEIFAEEMNKVDESFFHRLDDSFLVPEDKRGSKYPIFATLQEEKEYHKQF
PTIYHLRKQLAESNEKADLRLVYLALAHMIKYRGHFLIDDPKFKVQNNDIQGLFEKFVEEYDNVQE
TSLSKIKLNVTEILTAKIPKSEKQEQLLKNYPSEKKNTLFGNLIGLALGLTPNFKTNFSLENDAKLQIS
SESYEEDLGSLLALIGENFIELFSAVKNLSDGILLAGIVSDESPHAPLSAKMVIRFKEHEEDLAALKH
FIKANLPEKYDEVFSDDSKNGYAGYVGVDSKVRKRNGKLATEEEFYKYLKDILNNVKGADYFLEK
IKREDFLRKQRTFDNGTIPYQVHLAEMRAILHRQGDYYPFLKENKEKIEKILTFRIPYYVGPLARGN
RDFAWLTRNSDQAIRPWNFEEIVDQASSAEDFINKMTNYDLYLPEEKVLPKHSLLYETFAVYNELT
KVKFIAEGLRDYQFLDSGQKKQIVNQLFKDKRKVTEKDIIHYLHNVDGYDGIELKGIEKQFNASLS
TYHDLLKIIKDKEFMDDPKNEEILENIIHTLTIFEDREMIKQRLAQYDSLFDEKVIKALTRRHYTGWG
KLSAKLINGIYDKQSKKTILDYLIDDDKINRNFMQLINDDGLSFKEIIQKAQVVGKTDDVKQVVQEL
PGSPAIKKGILQSIKIVDELVKVMGHAPESIVIEMARENQTTARGKKNSQQRYKRIEDALKNLAPGL
DSNILKENPTDNIQLQNDRLFLYYLQNGKDMYTGEPLDINQLSSYDIDHIVPQAFIKDDSLDNRVLT
SSKDNRGKSDNVPSIEVVQKRKAFWQQLLDSKLISERKENNLTKAERGGLDERDKVGFIRQLVET
RQITKHVAQILDARFNTEVNEKNQRIRKVKIITLKSNLVSNFRKEFGLYKVREINDYHHAHDAYLN
AVVAKAILKKYPKLEPEFVYGDYQKYDIKRYISRSKDPKIEKATEKYFFYSNLLNFFKEEVHYAD
GTIIKRENIEYSKDTGEIAWNKEKDFATVRKVLSCPQVNIVKKTEVQTGGFSKESILPKRNSDKLIAR
KKDWDPKKYGGFDSPTVAYSVLVVAKVEKGKSKKLKSVKELVGITIMERSSFEKDPVDFLEAKGY
KEVRKDLIIKLPKYSLFELENGRKRMLASAGELQKGNELALPSKYVNFLYLASHYEKLKGSPEDNE
QKQLFVEQHKHYLDEIIEQISEFSKRVILADANLDKVLSAYNKHRDKPIREQAENIIHLFTLTNLGAP
AAFKYFDTTIDRKRYTSTKEVLDATLIHQSITGLYETRIDLSQLGGD |
| 228 | MKKSYSIGLDIGTNSVGWAVVNDDYKVPAKKMRVFGDTDRSHIKKNLLGTLLFDSGETAEGRRL
KRTARRRYTRRRNRILYLQEIFAEEMNKIDESFFHRLDDSFLVPEDKRGSKYPIFATLAEEKEYHKQ
FPTIYHLRKKLAESNEKADLRLVYLALAHMIKYRGHFLIDDPKFKVQNNDIQGLFEKFVEEYDNVQ
ETSLSKIKLNVTEILTANIPKSEKQEQLLKNYPSEKKNTLFGNLIGLALGLTPNFKTNFSLENDAKLQI
SSESYEEDLGNLLALIGENFIELFSAVKNLSDGILLAGIVSDESPHAPLSTKMVIRFKEHEEDLAALK
HFIKANLPEKYDEVFSDDSKNGYAGYVGVDSKVRKRNGKLATEEEFYKYLKNILNNIKGADYFLE
KIEREDLLRKQRTFDNGTIPYQVHLAEMRAILHRQGDYYPFLKENREKIEKILTFRIPYVGPLARG
NRDFAWLTRNSDQAIRPWNFEEVVDQASSAEDFINKMTNYDLYLPEEKVLPKHSLLYETFAVYNE
LTKVKFIAEGLRDYQFLDSGQKKQIVNQLFKEKRKVTEKDIIHYLHNVDGYDGIELKGIEKQFNASL
STYHDLLKIIKDKEFMDDPKNEEILENIVHTLTIFEDREMIKQRLAQYDSLFDEKVIKALTRRHYTG
WGKLSAKLINGICDKQTGNTILDYLIDDDKINRNFMQLINDDGLSFKEIIQKAQVVGKTDDVKQVV
QELPGSPAIKKGILQSIKIVDELVKVMGHAPESIVIEMARENQTTARGKKNSQQRYKRIEDALKNLA
PGLDSNILKEHPTDNIQLQNDRLFLYYLQNGKDMYTGESLDINQLSSYDIDHIVPQAFIKDDSLDNR
VLTSSKDNRGKSDNVPSIEVVQKRKAFWQQLLDSKLISERKENNLTKAERGGLDERDKVGFIKRQL
VETRQITKHVAQILDARFNTEVNEKGQKIRKVKIITLKSNLVSNFRKEFGLYKVREINDYHHAHDA
YLNAVVAKAILKKYPKLEPEFVYGDYQKYDIKRYISKSKDPKEIEKATEKYFFYSNLLNFFKEEVH
YADGTIIKRENIEYSKDTGEIAWNKEKDFATVRKVLSCPQVNIVKKTEVQTGGFSKESILPKRNSDK
LIARKKDWDPKKYGGFDSPTVAYSVLVVAKVEKGKSKKLKSVKELVGITIMERSSFEKDPVDFLE
AKGYKEVRKDLIIKLPKYSLFELENGRKRMLASAGELQKGNELALPSKYVNFLYLASHYEKLKGSP
EDNEQKQLFVEQHKHYLDEIIEQISEFSKRVILADANLDKVLSAYNKHRDKPIREQAENIIHLFTLTN
LGAPAAFKYFDTTIDRKRYTSTKEVLDATLIHQSITGLYETRIDLSQLGGD |
| 229 | MKKPYSIGLDIGTNSVGWAVITDDYKVPSKKMKVLGNTDKSHIKKNLIGALLFDSGNTAEDRRLK
RTARRRYTRRRNRILYLQEIFATEMNKVDESFFHRLDDSFLVPEDKRGSKYPIFGTLEEEKEYHKQF
PTIYHLRKQLAESNEKADLRLVYLALAHMIKYRGHFLIDDPKFKVQNNDIQGLFEKFVEEFDNVQE
TSLSKIKLNVTEILTANIPKSEKQEQLLKNYPSEKKNTLFGNLIGLALGLTPNFKTNFSLENDAKLQIS
SESYEEDLGNLLALIGENFIELFSAVKNLSDGILLAGIVSDESPHAPLSTKMVIRFKEHEEDLAALKH
FIKANLPEKYDEVFSDDSKNGYAGYVGVDSKVRKRNGKLATEEEFYKYLKDILNNVKGADYFLEK
IKREDFLRKQRTFDNGTIPYQVHLTEMKAILHRQGEYYPFLKENKEKIQQILTFRIPYYVGPLARGN
RDFAWLTRNSDQAIRPWNFEEVVDQASSAEDFINKMTNYDLYLPEEKVLPKHSLLYETFAVYNEL
TKVKFIAEGLRDYQFLDSGQKKQIVNQLFKEKRKVTEKDIIQFLHNVDGYDGIELKGIEKQFNASLS
TYHDLLKIIKDKEFMDDAKNEEILENIVHTLTIFEDREMIKQRLAQYDSLFDEKVIKALARRHYTGW
GKLSAKLINGICDKQTGDTILDYLIDDDKINRNFMQLIHDDGLSFKEIIQKAQVFGKTDDVKQVVQE
LPGSPAIKKGILQSIKIVDELVKVMGHAPESIVIEMARENQTTARGKKNSQQRYKRIEDSLKILASGL
NSKILKEHPTDNQALQNDRLFLYYLQNGKDMYTGEALDINQLSSYDIDHIIPQAFIKDDSLDNRVLT
SSKDNRGKSDNVPSIEVVQRRKAFWQQLLDSKLISERKENNLTKAERGGLDERDKVGFIKRQLVET
RQITKHVAQILDARFNTEVNEKNQKIRTVKIITLKSNLVSNFRKEFGLYKVREINDYHHAHDAYLN
AVVAKAILKKYPKLEPEFVYGDYQKYDLKRYISRSKDPKEVEKATEKYFFYSNLLNFFKEEVHYA
DGTIVKRENIEYSKDTGEIAWNKEKDFATVRKVLSCPQVNIVKKTEVQTGGFSKESILPKRNSDKLI
ARKKDWDPKKYGGFDSPTVAYSVLVVAKVEKGKSKKLKSVKELVGITIMERSSFEKDPVDFLEAK
GYKEVRKDLIIKLPKYSLFELENGRKRMLASAGELQKGNELALPSKYVNFLYLASHYEKLKGSPED
NEQKQLFVEQHKHYLDEIIEQISEFSKRVILADANLDKVLSAYNKHRDKPIREQAENIIHLFTLTNLG
APAAFKYFDTTIDRKRYTSTKEVLDATLIHQSITGLYETRIDLSQLGGD |

| SEQ ID NO | Nuclease Sequence |
|---|---|
| 230 | MKKSYSIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHMIKFRGHFLIEGQLNAENTDVQTLFNDFVEVYDKTVE<br>ESHLSEITVDALSILTEKVSKSRRLENLVKCYPTEKKNTLFGNLIALSLGLQPNFKTNFKLSEDAKLQ<br>FSKDTYEEDLEELLGKIGDEYADLFASAKNLYDAILLSGILTVDDNTTKAPLSASMVKRYAEHHED<br>LEKLKEFVKANKPELYHDIFKDETKNGYAGYIENGVKQDEFYKYLKNTLSKIAGSDYFLDKIERED<br>FLRKQRTFDNGSIPHQIHLQEMHAILRRQGEYYPFLKENQAKIEKILTFRIPYYVGPLARKNSRFAW<br>AEYHSDEKITPWNFEEIVDKEESATAFIHRMTNNDLYLPEEKVLPKHSLIYEEFTVYNELTKVKYVT<br>DQGKAYYFDANMKQEIFDGVFKEHRKVTKDKLMNFLEKEFDEFRIVDLTGLDKENKSFNASLGTY<br>HDLKKILDKSFLDDKTNETIIEDIIQTLTLFEDRDMIRQRLQKYSDIFTPQQLKKLERRHYTGWGRLS<br>YKLINGIRNKENGKTILDYLIDDGYANRNFMQLINDDTLPFKQIIQEAQIIGDIDDIETVVHDLPGSPA<br>IKKGILQSVKIVDELVKVMGHNPDNIVIEMARENQTTNRGRSQSQQRLKKLQESLKELGSNILNEEK<br>PSYVEDKVENSHLQNDKLFLYYIQNGKDMYTGEELDIDHLSDYDIDHIIPQAFIKDNSIDNRVLTSS<br>AKNRGKSDDVPSLDIVHDRKADWIRLYKSGLISKRKFDNLTKAEHGGLTEDDKAGFIKRQLVETR<br>QITKHVAQILDSRFNTERDENDKVIRDVKVITLKSNLVSQFRKDFELHKVREINDYHHAHDAYLNA<br>VIGNALLVKYPQLEPEFVYGKFKHFHGHKENKATAKKFFYSNIMALFKKDVEYSDDTGEMVWNK<br>EKDFATVRKVLSCPQVNIVKKTEVQTGGFSKESILPKRNSDKLIARKKDWDPKKYGGFDSPTVAYS<br>VLVVAKVEKGKSKKLKSVKELVGITIMERSSFEKNPIDFLEAKGYKEVRKDLIIKLPKYSLFELENG<br>RKRMLASAGELQKGNELALPSKYVNFLYLASHYEKLKGSPEDNEQKQLFVEQHKHYLDEIIEQISE<br>FSKRVILADANLDKVLSAYNKHRDKPIREQAENIIHLFTLTNLGAPAAFKYFDTTIDRKRYTSTKEV<br>LDATLIHQSITGLYETRIDLSQLGGD |
| 231 | MKKPYSIGLDIGTNSVGWAVVTDDYKVPAKKMKVLGNTDKSHIKKNLLGALLFDSGETAEGRRL<br>KRTARRRYTRRRNRILYLQEIFAEEMNKIDESFFHRLDDSFLVPEDKRGSKYPIFATLEEEKEYHKK<br>FPTIYHLRKHLAESNEKADLRLVYLALAHMIKYRGHFLIDDPKFKVQNNDIQGLFEKFVEEYDNVQ<br>ETSLSKIKLNVTEILTANIPKSEKQEQLLKNYPSEKKNTLFGNLIGLALGLTPNFKTNFSLENDAKLQI<br>SSESYEEDLGNLLALIGENFIELFSAVKNLSDGILLAGIVSDESPHAPLSTKMVIRFKEHEEDLAALK<br>HFIKANLPEKYDEVFSDDSKNGYAGYVGVDSKVRKRNGKLATEEEFYKYLKDILNNVKGADYFLE<br>KIKREDLLRKQRTFDNGTIPYQVHLSEMKAIIIHRQGEHYPFLKENKEKIEKILTFRIPYYVGPLARGN<br>RDFAWLTRNSDQAIRPWNFEEIVDKASSAEDFINKMTNYDLYLPEEKVLPKHSLLYETFAVYNELT<br>KVKFIAEGLRDYQFLDSGQKKQIVNQLFKEKRKVTEKDIIHYLHNVDGYDGIELKGIEKQFNASLST<br>YHDLLKIIKDKEFMDDPKNEEILENIVHTLTIFEDREMIKQRLAQYDSLFDEKVIKALTRRHYTGWG<br>KLSAKLINGIYDKQSKKTILDYLIDDGEINRNFMQLIHDDGLSFKEIIQKAQVFGKTDDVKQVVQEL<br>PGSPAIKKGILQSIKIVDELVKVMGHAPESIVIEMARENQTTARGKKNSQQRYKRIEDISKLNLASGL<br>DSNILKENPTDNVQLQNDRLFYYLQNGKDMYTGEALDINQLSNYDIDHIIPQAFIKDDSLDNRVLT<br>SSKDNRGKSDNVPSIEVVEKMKAFWQQLLDSKLISERKYNNLTKAERERGGLNELDKVGFIKRQL<br>VETRQITKHVAQILDARFNTEVNENNQKIRKVKIITLKSNLVSNFRKEFGLYKVREINDYHHAHDA<br>YLNAVVAKAILKKYPKLEPEFVYGDYQKYDIKRYISRSKDPKDIEKATEKYFFYSNLLNFFKEEVH<br>YADGTIIKRENIEYSKDTGEIAWNKEKDFATVRKVLSCPQVNIVKKTEVQTGGFSKESILPKRNSDK<br>LIPRKTEWDPKKYGGFDSPIVAYSVLVVAKVEKGKSKKLKPVKELVGITIMERSSFEKDPVDFLEA<br>KGYKEVRKDLIIKLPKYSLFELENGRKRMLASAGELQKGNELALPSKYVNFLYLASHYEKLKGSPE<br>DNEQKQLFVEQHKHYLDEIVEQISEFSERVILADANLDKILSAYNKHRDKPIREQAENIINLFTFTNL<br>GAPAAFKFFDTDIDRKRYTSTKEVLDATLIHQSITGLYETRIDLSQLGGD |
| 232 | MKKPYSIGLDIGTNSVGWAVITDDYKVPAKKMKVLGNTDKSHIKKNLLGALLFDSGNTAEDRRLK<br>RTARRRYTRRRNRILYLQEIFAEEMNKIDESFFHRLDDSFLVPEDKRGSKYPIFATLEEEKEYHKQFP<br>TIYHLRKKLAESNEKADLRLIYLALAHMIKYRGHFLIDDPKFKVQNNDIQGLFEKFVEEYDNVQET<br>SLSKIKLNVTEILTANIPKSEKQEQLLKNYPSEKKNTLFGNLIGLALGLTPNFKTNFSLENDAKLQISS<br>ESYEEDLGNLLALIGENFIELFSAVKNLSDGILLAGIVSDESPHAPLSTKMVIRFKEHEEDLAALKHFI<br>KANLPEKYDEVFSDDSKNGYAGYVGVDSKVRKRNGKLATEEEFYKYLKEILNNVKGADYFLEKI<br>KREDFLRKQRTFDNGTIPYQVHLAEMRAILHRQGDYYPFLKDNKEKIEKILTFRIPYYVGPLARGNR<br>DFAWLTRNSDQAIRPWNFEEVVDKASSAEDFINKMTNYDLYLPEEKVLPKHSLLYETFAVYNELT<br>KVKFIAEGLRDYQFLDSGQKKQIVNQLFKEKRKVTEKDIIQFLHNVDGYDGIELKGIEKQFNASLST<br>YHDLLKIITKDEFMDDPKNEEILENIVHTLTIFEDREMIKQRLAQYDSLFDEKVIKALTRRHYTGWG<br>KLSAKLINGIRDKQSNKTILDYLIDDDKINRNFMQLINDDGLSFKDIIQKAQVVGKTDDVKQVVQEL<br>PGSPAIKKGILQSIKIVDELVKVMGHAPESIVIEMARENQTTARGKKNSQQRYKRIEDALKNLAPGL<br>DSNILKENPTDNIQLQNDRLFYYLQNGKDMYTGESLDINQLSNYDIDHIVPQAFIKDDSLDNRVLTE<br>SSKDNRGKSDNVPSLEVVQKRKAFWQQLLDSKLISERKENNLTKAERGGLDERDKVGFIKRQLVE<br>TRQITKHVAQILDARFNTEVNEKNQKIRKVKIITLKSNLVSNFRKEFRLYKVREINDYHHAHDAYL<br>NAVVAKAILKKYPKLEPEFVYGDYQKYDIKRYISKSKDPKDIEKATQKYFFYSNLLNFFKEEVHYA<br>DGTIVKRENVEYSKDTGEIAWNKEKDFATVRKVLSCPQVNIVKKTEVQTGGFSKESILPKRNSDKLI<br>ARKKDWDPKKYGGFDSPTVAYSVLVVAKVEKGKSKKLKSVKELLGITIMERSSFEKNPIDFLEAK<br>GYKEVRKDLIIKLPKYSLFELENGRKRMLASAGELQKGNELALPSKYVNFLYLASHYEKLKGSPED<br>NEQKQLFVEQKHYLDEIIEQISEFSKRVILADANLDKVLSAYNKHRDKPIREQAENIIHLFTLTNLG<br>APAAFKYFDTTIDRKRYTSTKEVLDATLIHQSITGLYETRIDLSQLGGD |
| 233 | MKKSYSIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHMIKFRGHFLIEGQLNAENTDVQTLFNDFVEVYDKTVE<br>ESHLSEITVDALSILTEKVSKSRRLENLVKCYPTEKKNTLFGNLIALSLGLQPNFKTNFKLSEDAKLQ<br>FSKDTYEEDLEELLGKIGDEYADLFASAKNLYDAILLSGILTVDDNTTKAPLSASMVKRYAEHHED<br>LEKLKEFVKANKPELYHDIFKDETKNGYAGYIENGVKQDEFYKYLKNTLSKIAGSDYFLDKIERED<br>FLRKQRTFDNGSIPHQIHLQEMHAILRRQGEYYPFLKENQAKIEKILTFRIPYYVGPLARKNSRFAW<br>AEYHSDEKITPWNFEEIVDKEESATAFIHRMTNNDLYLPEEKVLPKHSLIYEEFTVYNELTKVKYVT |

| SEQ ID NO | Nuclease Sequence |
|---|---|
| | DQGKAYYFDANMKQEIFDGVFKEHRKVTKDKLMNFLEKEFDEFRIVDLTGLDKENKSFNASLGTY<br>HDLKKILDKSFLDDKTNETIIEDIIQTLTLFEDRDMIRQRLQKYSDIFTPQQLKKLERRHYTGWGRLS<br>YKLINGIRNKENGKTILDYLIDDGYANRNFMQLINDDTLPFKQIIQEAQIIGDIDDIETVVHDLPGSPA<br>IKKGILQSVKIVDELVKVMGHNPDNIVIEMARENQTTNRGRSQSQQRLKKLQESLKELGSNILNEEK<br>PSYVEDKVENSHLQNDKLFLYYIQNGKDMYTGEELDIDHLSDYDIDHIIPQAFIKDNSIDNRVLTSS<br>AKNRGKSDDVPSLDIVHDRKADWIRLYKSGLISKRKFDNLTKAEHGGLTEDDKAGFIKRQLVETR<br>QITKHVAQILDSRENTERDENDKVIRDVKVITLKSNLVSQFRKDFELHKVREINDYHHAHDAYLNA<br>VIGNALLVKYPQLEPEFVYGKFKHFHGHKENKATAKKFFYSNIMALFKKDVEYSDDTGEMVWNK<br>EKDFATVRKVLSCPQVNIVKKTEVQTGGFSKESILPKRNSDKLIARKKDWDPKKYGGFDSPTVAYS<br>VLVVAKVEKGKSKKLKSVKELVGITIMERSSFEKDPVDFLEAKGYKEVRKDLIIKLPKYSLFELENG<br>RKRMLASAGELQKGNELALPSKYVNFLYLASHYEKLKGSPEDNEQKQLFVEQHQHYLDEIIEQISE<br>FSKRVILADANLDKVLSAYNKHRDKPIREQAENIIHLFTLTNLGAPAAFKYFDTTIDRKRYTSTKEV<br>LDATLIHQSITGLYETRIDLSQLGGD |
| 234 | MNKPYSIGLDIGTNSVGWSVVDDDYKVPAKKMRVFGDTDKGHIKKNLLGTLLFDSGETAESRRLK<br>RTARRRYTRRRNRILYLQEIFAKEMAKVDESFFHRLDESFLTDDDKTFDSHPIFGNKAEEDAYHQQ<br>FPTIYHLRKHLADSTEKADLRLVYLALAHMIKFRGHFLIEGELNAENTDVQKLFADPVGVYDRTFD<br>DSHLSEITVDASSILTEKISKSRRLEKLIKHYPTEKKNTLFGNLVALALGLQPNFKTNFKLSEDAKLQ<br>FSKDTYEEDLEELLGKIGDDYADLFTSAKNLYDAILLSGILTVDDESTKAPLSASMIKRYAEHHEDL<br>EKLKEFVKANKPELYHDIFKDESKNGYAGYIENGVKQDEFYKYLKETLSKQDGSQYFLDKIEREDF<br>LRKQRTFDNGSIPHQLHLKEMRSILHRQGEYYPFLKENQAKIEKILTFRIPYYVGPLARKDSRFAWA<br>EYHSDEPITPWNFDEVVDKEKSAEKFITRMTLNDLYLPEEKVLPKHSHVYETYTVYNELTKVKYV<br>NEQGEAKFFDANMKQEIFDHVFKENRKVTKDKLMDFLGKEFDEFRIVDITGLDKENKAFNASLGT<br>YHDLKKILDKSFLDDKENETIIEDIIQTLTLFEDRDMIRQRLQKYSDIFTPQQLKKLERRHYTGWGRL<br>SYKLINGIRDKQTGKTILDYLIDDGYANRNFMQLINDDTLPFKEIIQKAQIIGDIDDIKAVVHDLPGSP<br>AIKKGILQSVKIVDELVKVMGHNPDNIVIEMARENQTTNRGRTQSQQRLKKLQESLKELGSNILNE<br>KKPSYVEDKVENTHLQNDRLFLYYIQNGKDMYTGDELDIDHLSDYDIDHIIPQAFIKDDSIDNRVLT<br>SSAKNRGKSDDVPSIEIVRDRKADWMRLRKAGLISKRKFDNLTKAERGGLTEADKAGFIKRQLVET<br>RQITKHVAQILDSRENTERDENDKVIREVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEIKLANGE<br>IRKRPLIETNEETGEIVWNKEKDFATVRKVLSCPQVNIVKKTEVQTGGFSKESILPKRNSDKLIARKK<br>DWDPKKYGGFDSPTVAYSVLVVAKVEKGKSKKLKSVKELVGITIMERSSFEKDPVDFLEAKGYKE<br>VRKDLIIKLPKYSLFELENGRKRMLASAGELQKGNELALPSKYVNFLYLASHYEKLKGSPEDNEQK<br>QLFVEQHKHYLDEIIEQISEFSKRVILADANLDKVLSAYNKHRDKPIREQAENIIHLFTLTNLGAPAA<br>FKYFDTTIDRKRYTSTKEVLDATLIHQSITGLYETRIDLSQLGGD |
| 235 | MNKPYSIGLDIGTNSVGWSVVDDDYKVPAKKMRVFGDTDKGHIKKNLLGTLLFDSGETAESRRLK<br>RTARRRYTRRRNRILYLQEIFAKEMAKVDESFFHRLDESFLTDDDKTFDSHPIFGNKAEEDAYHQQ<br>FPTIYHLRKHLADSTEKADLRLVYLALAHMIKFRGHFLIEGELNAENTDVQKLFADPVGVYDRTFD<br>DSHLSEITVDASSILTEKISKSRRLEKLIKHYPTEKKNTLFGNLVALALGLQPNFKTNFKLSEDAKLQ<br>FSKDTYEEDLEELLGKIGDDYADLFTSAKNLYDAILLSGILTVDDESTKAPLSASMIKRYAEHHEDL<br>EKLKEFVKANKPELYHDIFKDESKNGYAGYIENGVKQDEFYKYLKETLSKQDGSQYFLDKIEREDF<br>LRKQRTFDNGSIPHQLHLKEMRSILHRQGEYYPFLKENQAKIEKILTFRIPYYVGPLARKDSRFAWA<br>EYHSDEPITPWNFDEVVDKEKSAEKFITRMTLNDLYLPEEKVLPKHSHVYETYTVYNELTKVKYV<br>NEQGEAKFFDANMKQEIFDHVFKENRKVTKDKLMDFLGKEFDEFRIVDITGLDKENKAFNASLGT<br>YHDLKKILDKSFLDDKENETIIEDIIQTLTLFEDRDMIRQRLQKYSDIFTPQQLKKLERRHYTGWGRL<br>SYKLINGIRDKQTGKTILDYLIDDGYANRNFMQLINDDTLPFKEIIQKAQIIGDIDDIKAVVHDLPGSP<br>AIKKGILQSVKIVDELVKVMGHNPDNIVIEMARENQTTNRGRTQSQQRLKKLQESLKELGSNILNE<br>KKPSYVEDKVENTHLQNDRLFLYYIQNGKDMYTGDELDIDHLSDYDIDHIIPQAFIKDDSIDNRVLT<br>SSAKNRGKSDDVPSIEIVRDRKADWMRLRKAGLISKRKFDNLTKAERGGLTEADKAGFIKRQLVET<br>RQITKHVAQILDSRENTERDENDKVIREVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEIKLANGE<br>IRKRPLIETNEETGEIVWNKEKDFATVRKVLSCPQVNIVKKTEVQTGGFSKESILPKRNSDKLIARKK<br>DWDPKKYGGFDSPTVAYSVLVVAKVEKGKSKKLKSVKELVGITIMERSSFEKDPVDFLEAKGYKE<br>VRKDLIIKLPKYSLFELENGRKRMLASAGELQKGNELALPSKYVNFLYLASHYEKLKGSPEDNEQK<br>QLFVEQHQHYLDEIIEQISEFSKRVILADANLDKVLSAYNKHRDKPIREQAENIIHLFTLTNLGAPAA<br>FKYFDTTIDRKRYTSTKEVLDATLIHQSITGLYETRIDLSQLGGD |
| 236 | MKKPYSIGLDIGTNSVGWAVVTDDYKVPAKKMKVLGNTDKSHIKKNLLGALLFEGGETAEGRRL<br>KRTARRRYTRRRNRILYLQEIFATEMNKVDESFFHRLDDSFLVPEDKRGSKYPIFGTLEEEKEYHKQ<br>FPTIYHLRKQLAESNEKADLRLVYLALAHMIKYRGHFLIDDPKFKVQNNDIQGLFEKFVEEYDNVQ<br>ETSLSKIKLNVTEILTANIPKSEKQEQLLKNYPSEKKNTLFGNLIGLALGLTPNFKTNFSLENDAKLQI<br>SSESYEEDLGNLLALIGENFIELFSAVKNLSDGILLAGIVSDESPHAPLSTKMVIRPKEHEEDLAALK<br>HFIKANLPEKYDEVFSDDSKNGYAGYVGVDSKVRKRNGKLATEEEFYKYLKDILNNVKGADYFLE<br>KIKREDFLRKQRTFDNGTIPYQVHLQEMKAILHRQGEHYPFLKENKEKIEKILTFRIPYYVGPLARG<br>NRDFAWLTRNSDQAIRPWNFEEIVDKASSAEDFINKMTNYDLYLPEEKVLPKHSLLYETFAVYNEL<br>TKVKFIAEGLRDYQFLDSGQKKQIVNQLFKEKRKVTEKDIIHYLHNVDGYDGIELKGIEKQFNASLS<br>TYHDLLKIIKDKEFMDDPKNEEILENIVHTLTIFEDREMIKQRLAQYDSLFDEKVIKALTRRHYTGW<br>GKLSAKLINGIYDKQSQKTILDYLIDDDKINRNFMQLINDDGLSFKEIIQKAQVVGKTDDVKQVVQ<br>ELPGSPAIKKGILQSIKIVDELVKVMGHAPESIVIEMARENQTTARGKKNSQQRYKRIEDALKNLAP<br>GLDSNILKENPTDNVQLQNDRLFLYYLQNGRDMYTGKPLDINQLSNYDIDHIIPQAFIKDDSLDNRV<br>LTSSKDNRGKSDNVPSIEVVEKMKAFWQQLLDSKLISERKYNNLTKAERERGGLNELDKVGFIKR<br>QLVETRQITKHVAQILDARFNTEVNENNQKIRKVKIITLKSNLVSNFRKEFGLYKVREINDYHHAHD<br>AYLNAVVAKAILKKYPKLEPEFVYGDYQKYDLKRYISRSKDPKDIEKATEKYFFYSNLLNFFKEEV |

| SEQ ID NO | Nuclease Sequence |
|---|---|
|  | HYADGTIIKRENIEYSKDTGEIAWNKEKDFATVRKVLSCPQVNIVKKTEVQTGGFSKESILPKRNSD<br>KLIPRKTEWDPKKYGGFDSPTVAYSVLVVAKVEKGKSKKLKSVKELVGITIMERSSFEKDPVDFLE<br>AKGYKEVRKDLIIKLPKYSLFELENGRRRLLASAGELQKGNELALPSKYVNFLYLASHYEKLKGSP<br>EDNEQKQLFVEQHKHYLDEIVEQISEFSERVILADANLDKVLSAYNKNRDRPIREQAENIIHLFTLTN<br>LGAPAAFKFFDTTIDRKRYTSTKEVLDATLIHQSITGLYETRIDLSQLGGD |
| 237 | MKKPYSIGLDIGTNSVGWAVVTDDYKVPAKKMKVLGDTDKSHIKKNLLGTLLFESGETAEGRRLK<br>RTARRRYTRRRNRILYLQEIFAEEMNKVDDSFFQRLDESFLKDDDKNFDSHPIFGNKAEEDAYHQK<br>FPTIYHLRQYLADSPEKADLRLVYLALAHIIKYRGHELFEGDLKSENKDVQHLFNDFVEMFDKTVE<br>GSYLSENLPNVADVLVEKVSKSRRLENVLHYFPNEKKNGLFGNFIALALGLQPNFKTNFKLSEDAK<br>LQFSKDTYDEDLEELLGKIGDDYADLFVAAKNLYDAILLSGILTVTDPTTKAPLSASMIDRYEKHH<br>KDLALLKNLIKQNLTQEKYDEVFSDESKNGYAGYISGKVKQEEFYKLKNTLSKIEGSDYFLDKIE<br>REDFLRKQRTFDNGSIPHQIHLQEMNAIIRRQGEHYPFLKENKEKIEKILTFRIPYYVGPLARGNRDF<br>AWLTRNSDQAIRPWNFEEIVDQASSAEDFINKMTNYDLYLPEEKVLPKHSLLYETFAVYNELTKVK<br>FIAEGLRDYQFLDSGQKKQIVNQLFKEKRKVTEKDIIQYLHNVDGYDGIELKGIEKQFNASLSTYHD<br>LLKIIKDKEFMDDPKNEEILENIVHTLTIFEDREMIKQRLAQYDSLFDEKVIKALTRRHYTGWGKLS<br>AKLINGIYDKQSKKTILDYLIDDGEINRNFMQLINDDGLSFKDIIQKAQVVGKTNDVKQVVQELPGS<br>PAIKKGILQSIKLVDELVKVMGHAPESIVIEMARENQTTARGKKNSQQRYKRIEDALKNLAPGLDS<br>NILKENPTDNIQLQNDRLFLYYLQNGKDMYTGEALDINQLSNYDIDHIVPQAFIKDDSLDNRVLTSS<br>KDNRGKSDNVPSIEVVQKRKAFWQQLLDSKLISERKENNLTKAERGGLDERDKVGFIKRQLVETR<br>QITKHVAQILDARFNTEVDENNQRIRKVKIITLKSNLVSNFRKEFGLYREINDYHHAHDAYLNA<br>VVAKAILKKYPKLEPEFVYGDYQKYDLKRYISRSKDPKDIEKATEKYFFYSNLLNFFKEEVHYADG<br>TIIKRENIEYSNDTGEIAWNKEKDFATVRKVLSCPQVNIVKKTEVQTGGFSKESILPKRNSDKLIARK<br>KDWDPKKYGGFDSPTVAYSVLVVAKVEKGKSKKLKSVKELVGITIMERSSFEKDPIDFLEAKGYK<br>EVRKDLIIKLPKYSLFELENGRKRMLASAGELQKGNELALPSKYVNFLYLASHYEKLKGSPEDNEQ<br>KQLFVEQHKHYLDEIIEQISEFSKRVILADANLDKVLSAYNKHRDKPIREQAENIIHLFTLTNLGAPA<br>AFKYFDTTIDRKRYTSTKEVLDATLIHQSITGLYETRIDLSQLGGD |
| 238 | MKKSYTIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDTYHDE<br>FPTIYHLRQYLADSPQKADLRLVYLALAHMIKFRGHFLIEGQLNAENTNVQTLFNDFVEVYDKTVE<br>ESHLSEITVDALSILTEKVSKSRRLENVLVKCYPTEKKNTLFGNLIALSLGLQPNFKTNFKLSEDAKLQ<br>FSKDTYEEDLEELLGKIGDYADLFASAKNLYDAILLSGILTVDDNSTKAPLSASMVKRYAEHHED<br>LEKLKEFVKANKPELYHDIFKDETKNGYAGYIENGVKQDEFYKYLKNTLSKIAGSDYFLDKIERED<br>FLRKQRTFDNGSIPHQIHLQEMHAILRRQGEHYPFLKENQAKIEKILTFRIPYYVGPLARKNSRFAW<br>AEYHSDEKITPWNFEEIVDKEESATAFIHRMTNNDLYLPEEKVLPKHSLIYEEFTVYNELTKVKYVT<br>DQGKAYYFDANMKQEIFDGVFKEHRKVTKDKLMNFLEKEFDEFRIVDLTGLDKENKSFNASLGTY<br>HDLKKILDKSFLDDKTNETIIEDIIQTLTLFEDRDMIRQRLQKYSDIFTPQQLKKLERRHYTGWGRLS<br>YKLINGIRNKENGKTILDYLIDDGYANRNFMQLINDDTLPFFKQIIQEAQIIGDIDDIETVVHDLPGSPA<br>IKKKGILQSVKIVDELVKVMGHNPDNIVIEMARENQTTNRGRSQSQQRLKKLQESLKELGSNILNEEK<br>PSYVEDKVENSHLQNDKLFLYYIQNGKDMYTGEELDIDHLSDYDIDHIIPQAFIKDNSIDNRVLTSS<br>AKNRGKSDDVPSLDIVHDRKADWIRLYKSGLISKRKFDNLTKAEHGGLTEDDKAGFIKRQLVETR<br>QITKHVAQILDSRENTERDENDKVIRDVKVITLKSNLVSQFRKDFELHKVREINDYHHAHDAYLNA<br>VIGNALLVKYPQLEPEFVYGKFSHFHGHKENKATAKKFFYSNIMALFKKDVEYSDDTGEMVWNK<br>EKDFATVRKVLSCPQVNIVKKTEVQTGGFSKESILPKRNSDKLIPRKKNWDPKKYGGFDSPTVAYS<br>VLVIAKVEKGKSKKLPVKELIGITIMERSSFEKNPIDFLEAKGYKEVRKDLIIKLPKYSLFELENGR<br>KRMLASAGELQKGNELALPSKYVNFLYLASHYEKLKGSPEDNEQKQLFVEQHKHYLDEIIEQISEF<br>SERVILADANLDKVLSAYNNHRDKPIREQAENIIHLFTLTNLGAPAAFKFFDTTIDRKRYTSTKEVL<br>DATLIHQSITGLYETRIDLSQLGGD |
| 239 | MKKSYSIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHMIKFRGHFLIEGQLNAENTDVQTLFNDFVEVYDKTVE<br>ESHLSEITVDALSILTEKVSKSRRLENVLVKCYPTEKKNTLFGNLIALSLGLQPNFKTNFKLSEDAKLQ<br>FSKDTYEEDLEELLGKIGDEYADLFASAKNLYDAILLSGILTVDDNTTKAPLSASMVKRYAEHHED<br>LEKLKEFVKANKPELYHDIFKDETKNGYAGYIENGVKQDEFYKYLKNTLSKIAGSDYFLDKIERED<br>FLRKQRTFDNGSIPHQIHLQEMHAILRRQGEYYPFLKENQAKIEKILTFRIPYYVGPLARKNSRFAW<br>AEYHSDEKITPWNFEEIVDKEESATAFIHRMTNNDLYLPEEKVLPKHSLIYEEFTVYNELTKVKYVT<br>DQGKAYYFDANMKQEIFDGVFKEHRKVTKDKLMNFLEKEFDEFRIVDLTGLDKENKSFNASLGTY<br>HDLKKILDKSFLDDKTNETIIEDIIQTLTLFEDRDMIRQRLQKYSDIFTPQQLKKLERRHYTGWGRLS<br>YKLINGIRNKENGKTILDYLIDDGYANRNFMQLINDDTLPFFKQIIQEAQIIGDIDDIETVVHDLPGSPA<br>IKKKGILQSVKIVDELVKVMGHNPDNIVIEMARENQTTNRGRSQSQQRLKKLQESLKELGSNILNEEK<br>PSYVEDKVENSHLQNDKLFLYYIQNGKDMYTGEELDIDHLSDYDIDHIIPQAFIKDNSIDNRVLTSS<br>AKNRGKSDDVPSLDIVHDRKADWIRLYKSGLISKRKFDNLTKAEHGGLTEDDKAGFIKRQLVETR<br>QITKHVAQILDSRENTERDENDKVIRDVKVITLKSNLVSQFRKDFELHKVREINDYHHAHDAYLNA<br>VIGNALLVKYPQLEPEFVYGKFKHFHGHKENKATAKKFFYSNIMALFKKDVEYSDDTGEMVWNK<br>EKDFATVRKVLSCPQVNIVKKTEVQTGGFSKESILPKRNSDKLIARKKDWDPKKYGGFDSPTVAYS<br>VLVVAKVEKGKSKKLKSVKELVGITIMERSSFEKDPVDFLEAKGYKEVRKDLIIKLPKYSLFELENG<br>RKRMLASAGELQKGNELALPSKYVNFLYLASHYEKLKGSPEDNEQKQLFVEQHKHYLDEIIEQISE<br>FSKRVILADANLDKVLSAYNKHRDKPIREQAENIIHLFTLTNLGAPAAFKYFDTTIDRKRYTSTKEV<br>LDSTLIHQSITGLYETRIDLSQLGGD |
| 240 | MKKPYSIGLDIGTNSVGWAVVTDDYKVPAKKMKVLGNTDKSHIKKNLLGALLFDSGNTAEDRRL<br>KRTARRRYTRRRNRILYLQEIFAEEMNKVDESFFHRLDDSFLVPEDKRGSKYPIFGTLEEEKEYHKQ |

| SEQ ID NO | Nuclease Sequence |
|---|---|
| | FPTIYHLRKQLAESNEKADLRLVYLALAHMIKYRGHFLIDDPKFKVQNNDIQGLFEKFVEEYDNVQ<br>ETSLSKIKLNVTEILTANIPKSEKQEQLLKNYPSEKKNTLFGNLIGLALGLTPNFKTNFSLENDAKLQI<br>SSESYEEDLGSLLALIGENFIELFSAVKNLSDGILLAGIVSDESPHAPLSTKMVIRFKEHEEDLAALKH<br>FIKANLPEKYDEVFSDDSKNGYAGYVGVDSKVRKRNGKLATEEEFYKYLKEILNNLKGADYFLEK<br>IKREDLLRKQRTFDNGTIPYQVHLTEMKAIIHRQGEHYPFLKENKEKIEKILTFRIPYYVGPLARGNR<br>DFAWLTRNSDQAIRPWNFEEVVDKASSAEDFINKMTNYDLYLPEEKVLPKHSLLYETFAVYNELT<br>KVKFIAEGLRDYQFLDSGQKKQIVNQLFKEKRKVTEKDIIHYLHNVDGYDGIELKGIEKQFNASLST<br>YHDLLKIIKDKEFMDDPKNEEILENIVHTLTIFEDREMIKQRLAQYDSLFDEKVIKALTRRHYTGWG<br>KLSAKLINGICDKQTGKTILDYLIDDDKINRNFMQLINDDGLSFKEIIQKAQVVGKTDDVKQVVQEL<br>PGSPAIKKGILQSIKIVDELVKVMGHAPESIVIEMARENQTTARGKKNSQQRYKRIEDALKNLAPGL<br>DSNILKENPTDNIQLQNDRLFLYYLQNGKDMYTGEALDINQLSNYDIDHIIPQAFIKDDSLDNRVLT<br>SSKDNRGKSDNVPSLEVVEKMKAFWQQLLDSKLISERKYNNLTKAERERGGLNELDKVGFIKRQL<br>VETRQITKHVAQILDARFNTEVNENNQKIRKVKIITLKSNLVSNFRKEFGLYKVREINDYHHAHDA<br>YLNAVVAKAILKKYPKLEPEFVYGDYQKYDIKRYISRSKDPKEIEKATEKYFFYSNLLNFFKEEVH<br>YADGTIVKRENIEYSKDTGEIAWNKEKDFATVRKVLSCPQVNIVKKTEVQTGGFSKESILPKRNSD<br>KLIPRKTEWDPKKYGGFDSPTVAYSVLVVAKVEKGKSKKLKSVKELVGITIMERSSFEKDPVDFLE<br>AKGYKEVRKDLIIKLPKYSLFELENGRRRLLASAGELQKGNELALPSKYVNFLYLASHYEKLKGSP<br>EDNEQKQLFVEQHKYHLDEIVEQISEFSERVILADANLDKVLSAYNKNRDRPIREQAENIIHLFTLTN<br>LGAPAAFKFFDTTIDRKRYTSTKEVLDATLIHQSITGLYETRIDLSQLGGD |
| 241 | MKKSYSIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHMIKFRGHFLIEGQLNAENTDVQTLFNDFVEVYDKTVE<br>ESHLSEITVDALSILTEKVSKSRRLENLVKCYPTEKKNTLFGNLIALSLGLQPNFKTNFKLSEDAKLQ<br>FSKDTYEEDLEELLGKIGDEYADLFASAKNLYDAILLSGILTVDDNTTKAPLSASMVKRYAEHHED<br>LEKLKEFVKANKPELYHDIFKDETKNGYAGYIENGVKQDEFYKYLKNTLSKIAGSDYFLDKIERED<br>FLRKQRTFDNGSIPHQIHLQEMHAILRRQGEYYPFLKENQAKIEKILTFRIPYYVGPLARKNSRFAW<br>AEYHSDEKITPWNFEEIVDKEESATAFIHRMTNNDLYLPEEKVLPKHSLIYEEFTVYNELTKVKYVT<br>DQGKAYYFDANMKQEIFDGVFKEHRKVTKDKLMNFLEKEFDEFRIVDLTGLDKENKSFNASLGTY<br>HDLKKILDKSFLDDKTNETIIEDIIQTLTLFEDRDMIRQRLQKYSDIFTPQQLKKLERRHYTGWGRLS<br>YKLINGIRNKENGKTILDYLIDDGYANRNFMQLINDDTLPFKQIIQEAQIIGDIDDIETVVHDLPGSPA<br>IKKGILQSVKIVDELVKVMGHNPDNIVIEMARENQTTNRGRSQSQQRLKKLQESLKELGSNILNEEK<br>PSYVEDKVENSHLQNDKLFLYYIQNGKDMYTGEELDIDHLSYDIDHIIPQAFIKDNSIDNRVLTSS<br>AKNRGKSDDVPSLDIVHDRKADWIRLYKSGLISKRKFDNLTKAEHGGLTEDDKAGFIKRQLVETR<br>QITKHVAQILDSRENTERDENDKVIRDVKVITLKSNLVSQFRKDFELHKVREINDYHHAHDAYLNA<br>VIGNALLVKYPQLEPEFVYGKFKHFHGHKENKATAKKFFYSNIMALFKKDVEYSDDTGEMVWNK<br>EKDFATVRKVLSCPQVNIVKKTEVQTGGFSKESILPKRNSDKLIARKKDWDPKKYGGFDSPTVAYS<br>VLVVAKVEGKSKKLKSVKELLGITIMERSSFEKNPIDFLEAKGYKEVRKDLIIKLPKYSLFELENG<br>RKRMLASAGELQKGNELALPSKYVNFLYLASHYEKLKGSPEDNEQKQLFVEQHKYHLDEIIEQISE<br>FSKRVILADANLDKVLSAYNKHRDKPIREQAENIIHLFTLTNLGAPAAFKYFDTTIDRKRYTSTKEV<br>LDATLIHQSITGLYETRIDLSQLGGD |
| 242 | MNKPYSIGLDIGTNSVGWSVVDDDYKVPAKKMRVFGDTDKGHIKKNLLGTLLFDSGETAESRRLK<br>RTARRRYTRRRNRILYLQEIFAKEMAKVDESFFHRLDESFLTDDDKTFDSHPIFGNKAEEDAYHQQ<br>FPTIYHLRKHLADSTEKADLRLVYLALAHMIKFRGHFLIEGELNAENTDVQKLFADFVGVYDRTFD<br>DSHLSEITVDASSILTEKISKSRRLEKLIKHYPTEKKNTLFGNLIALALGLQPNFKTNFKLSEDAKLQ<br>FSKDTYEEDLEELLGKIGDDYADLFTSAKNLYDAILLSGILTVDDESTKAPLSASMIKRYAEHHEDL<br>EKLKEFVKANKPELYHDIFKDETKNGYAGYIENGVKQDEFYKYLKETLSKQDGSQYFLDKIEREDF<br>LRKQRTFDNGSIPHQLHLKEMRSILHRQGEYYPFLKENQAKIEKILTFRIPYYVGPLARKDSRFAWA<br>EYHSDEPITPWNFDEVVDKEKSAEKFITRMTLNDLYLPEEKVLPKHSHVYETYTVYNELTKVKYV<br>NEQGEAKFFDANMKQEIFDHVFKENRKVTKDKLMNFLGKEFDEFRIVDITGLDKENKAFNASLGT<br>YHDLKKILDKSFLDDKENETIIEDIIQTLTLFEDRDMIRQRLQKYSDIFTPQQLKKLERRHYTGWGRL<br>SYKLINGIRDKQTGKTILDYLIDDGYANRNFMQLINDDTLPFKEIIQKAQIIGDIDDIKAVVHDLPGSP<br>AIKKGILQSVKIVDELVKVMGHNPDNIVIEMARENQTTNRGRTQSQQRLKKLQESLKELGSNILNE<br>KKPSYVEDKVENTHLQNDRLFLYYIQNGKDMYTGDELDIDHLSYDIDHIIPQAFIKDDSIDNRVLT<br>SSAKNRGKSDDVPSIEIVRDRKADWMRLRKAGLISKRKFDNLTKAERGGLTEADKAGFIKRQLVET<br>RQITKHVAQILDSRENTERDENDKVIREVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEIKLANGE<br>IRKRPLIETNEETGEIVWNKEKDFATVRKVLSCPQVNIVKKTEVQTGGFSKESILPKRNSDKLIPRKK<br>DWDPKKYGGFDSPTVAYSVLVVAKVEKGKSKKLKSVKELLGITIMERSSFEKNPIDFLEAKGYKEV<br>KKDLIIKLPKYSLFELENGRKRMLASAGELQKGNELALPSKYVNFLYLASHYEKLKGSPEDNEQKQ<br>LFVEQHKYHLDEIIEQISEFSERVILADANLDKVLSAYNKHRDKPIREQAENIIHLFTLTNLGAPAAF<br>KFFDTTIDRKRYTSTKEVLDATLIHQSITGLYETRIDLSQLGGD |
| 243 | MKKSYSIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHMIKFRGHFLIEGQLNAENTNVQTLFNDFVEVYDKTVE<br>ESHLSEITVDALSILTEKVSKSRRLENLVKCYPTEKKNTLFGNLIALSLGLQPNFKTNFKLSEDAKLQ<br>FSKDTYEEDLEELLGKIGDEYADLFASAKNLYDAILLSGILTVDDNSTKAPLSASMVKRYAEHHED<br>LEKLKEFVKANKPELYHDIFKDETKNGYAGYIENGVKQDEFYKYLKNTLSKIAGSDYFLDKIERED<br>FLRKQRTFDNGSIPHQIHLQEMHAILRRQGEYYPFLKENQAKIEKILTFRIPYYVGPLARKNSRFAW<br>AEYHSDEKITPWNFEEIVDKEESATAFIHRMTNNDLYLPEEKVLPKHSLIYEEFTVYNELTKVKYVT<br>DQGKAYYFDANMKQEIFDGVFKEHRKVTKDKLMNFLEKEFDEFRIVDLTGLDKENKSFNASLGTY<br>HDLKKILDKSFLDDKTNETIIEDIIQTLTLFEDRDMIRQRLQKYSDIFTPQQLKKLERRHYTGWGRLS |

| SEQ ID NO | Nuclease Sequence |
|---|---|
| | YKLINGIRNKENGKTILDYLIDDGYANRNFMQLINDDTLPFKQIIKEAQIIGDIDDIETVVHDLPGSPA
IKKGILQSVKIVDELVKVMGHNPDNIVIEMARENQTTNRGRSQSQQRLKKLQESLKELGSNILNEEK
PSYVEDKVENSHLQNDRLFYYIQNGKDMYTGEELDIDHLSDYDIDHIIPQAFIKDNSIDNRVLTSS
AKNRGKSDDVPSLDIVHDRKADWIRLYKSGLISKRKFDNLTKAEHGGLTEDDKAGFIKRQLVETR
QITKHVAQILDSRENTERDENDKVIRDVKVITLKSNLVSQFRKDFELHKVREINDYHHAHDAYLNA
VIGNALLVKYPQLEPEFVYGKFKHFHGHKENKATAKKFFYSNIMALFKKDVEYSDDTGEMVWNK
EKDFATIRKVLSCPQVNIVKKTEVQTGGFSKESILPKRNSDKLIPRKKNWDPKKYGGFDSPTVAYSV
LVVAKVEKGKSKKLKPVKELIGITIMERNSFEKDPIDFLEAKGYKEVRKDLIIKLPKYSLFELENGRK
RMLASAGELQKGNELALPSKYVNFLYLASHYEKLKGSPEDNEQKQLFVEQHKHYLDEIIEQISEFSE
RVILADANLDKVLSAYNNHRDKPIREQAENIIHLFTLTNLGAPAAFKFFDTTIDRKRYTSTKEILDAT
LIHQSITGLYETRIDLSQLGGD |
| 244 | MKKSYSIGLDIGTNSVGWSVITDDYKVPAKKMKVLGNTDKKYIKKNLLGALLFDSGETAEATRLK
RTARRRYTRRKNRLRYLQEIFAKEMAKVDESFFQRLEESFLTDDDKNFDSHPIFGNKAEEDAYHDE
FPTIYHLRQYLADSPQKADLRLVYLALAHMIKFRGHFLIEGQLNAENTDVQTLFNDFVEVYDKTVE
ESHLSEITVDALSILTEKVSKSRRLENLVKCYPTEKKNTLFGNLIALSLGLQPNFKTNFKLSEDAKLQ
FSKDTYEEDLEELLGKIGDEYADLFASAKNLYDAILLSGILTVDDNTTKAPLSASMVKRYAEHHED
LEKLKEFVKANKPELYHDIFKDETKNGYAGYIENGVKQDEFYKYLKNTLSKIAGSDYFLDKIERED
FLRKQRTFDNGSIPHQIHLQEMHAILRRQGEYYPFLKENQAKIEKILTFRIPYYVGPLARKNSRFAW
AEYHSDEKITPWNFEEIVDKEESATAFIHRMTNNDLYLPEEKVLPKHSLIYEEFTVYNELTKVKYVT
DQGKAYYFDANMKQEIFDGVFKEHRKVTKDKLMNFLEKEFDEFRIVDLTGLDKENKSFNASLGTY
HDLKKILDKSFLDDKTNETIIEDIIQTLTLFEDRDMIRQRLQKYSDIFTPQQLKKLERRHYTGWGRLS
YKLINGIRNKENGKTILDYLIDDGYANRNFMQLINDDTLPFKQIIQEAQIIGDIDDIETVVHDLPGSPA
IKKGILQSVKIVDELVKVMGHNPDNIVIEMARENQTTNRGRSQSQQRLKKLQESLKELGSNILNEEK
PSYVEDKVENSHLQNDKLFYYIQNGKDMYTGEELDIDHLSDYDIDHIIPQAFIKDNSIDNRVLTSS
AKNRGKSDDVPSLDIVHDRKADWIRLYKSGLISKRKFDNLTKAEHGGLTEDDKAGFIKRQLVETR
QITKHVAQILDSRENTERDENDKVIRDVKVITLKSNLVSQFRKDFELHKVREINDYHHAHDAYLNA
VIGNALLVKYPQLEPEFVYGKFKHFHGHKENKATAKKFFYSNIMALFKKDVEYSDDTGEMVWNK
EKDFATVRKVLSCPQVNIVKKTEVQTGGFSKESILPKRNSDKLIARKKDWDPKKYGGFDSPTVAYS
VLVVAKVEKGKSKKLKSVKELVGITIMERSSFEKDPIDFLEAKGYKEVRKDLIIKLPKYSLFELENG
RKRMLASAGELQKGNELALPSKYVNFLYLASHYEKLKGSPEDNEQKQLFVEQHKHYLDEIIEQISE
FSKRVILADANLDKVLSAYNKHRDKPIREQAENIIHLFTLTNLGAPAAFKYFDTTIDRKRYTSTKEV
LDATLIHQSITGLYETRIDLSQLGGD |
| 245 | MTKPYSIGLDIGTNSVGWAVITDSYKVPSKKMKVLGNTSKKYVKKNLLGALLFESGITAEGRRLK
RTARRRYTRRRNRILYLQEIFSTEMAKIDESFFQRLDDSFLVPDDKRDSKYPIFGNLVKEKTYHDEF
PTIYHLRKYLADSSKKADLRLVYLALAHMIKYRGHFLIEGDFNSRNNDIKKNFQNFLDSYNAIFESD
LSLENSKQLEEIVKDKISKSAKRERVLKLFPDEKSTGLFSEFLKLIVGNQADFKKHFDLEEKAPLQFS
KDTYDEDLENLLGQIGDDFADLFLVAKKLYDAILLSGILTVTDPSTKAPLSASMIERYENHQKDLSA
LKQFIRSNLSEKYDEVFSDQSKDGYAGYINGKTTQEAFYKYIKNLLSKFEGADYFLDKIEREDFLRK
QRTFDNGSIPHQIHLQEMNAIIRRQGEHYPFLKENKEKIEKILTFRIPYYVGPLARGNRDFAWLTRNS
DQAIRPWNFEEVVDKASSAEAFINKMTNFDLYLPEEKVLPKHSLLYETFAVYNELTKVKFIAEGLR
DYQFLDSGQKKQIVNQLFKEKRKVTEKDIIQFLHNVDGYDGIELKGIEKQFNASLATYHDLLKIIKD
KEFMDDPKNEEILENIIHTLTIFEDREMIKQRLAQYDSLFDEKVIKALTRRHYTGWGKLSAKLINGIC
DKQTGKTILDYLIDDGFANRNFMQLINDDTLPFKQIIQKAQIVGDVDDIEQVVHNLPGSPAIKKGIL
QSIKIVDELVKVMGHNPDNIVIEMARENQTTNRGRSQSQQRLKKLQESLKELGSNILNEEKPSYVES
KVENSQLQNDRLFYYIQNGKDMYTGEELDIDRLSDYDIDHIIPQAFIKDDSIDNRVLTSSAKNRGK
SDDVPSLEVVKKRKTYWHQLLKAKLISQRKFDNLTKAERGGLTEKDKAGFIKRQLVETRQITKHV
AQILDSRFNTKRDENDKVIRDVKVITLKSNLVSQFRKDFGFYKVREINDYHHAHDAYLNAVVGTA
LLKKYPKLAPEFVYGEYKKYDVRKIVRSKDESSLGKATAKMFFYSNLMNPFVKKEVRLSDGTVIY
PVIEYSKDTGEIAWNKEKDFATVRKVLSCPQVNIVKKTEVQTGGFSKESILPKRNSDKLIARKKDW
DPKKYGGFDSPTVAYSVLVVAKVEKGKSKKLKSVKELVGITIMERSSFEKDPVDFLEAKGYKEVR
KDLIIKLPKYSLFELENGRKRMLASAGELQKGNELALPSKYVNFLYLASHYEKLKGSPEDNEQKQL
FVEQHKHYLDEIIEQISEFSKRVILADANLDKVLSAYNKHRDKPIREQAENIIHLFTLTNLGAPAAFK
YFDTTIDRKRYTSTKEVLDSTLIHQSITGLYETRIDLSQLGGD |
| 246 | MKKPYSIGLDIGTNSVGWAVVTDDYKVPAKKMKVLGNTDKSHIKKNLLGALLFDSGNTAEDRRL
KRTARRRYTRRRNRILYLQEIFAEEMNKVDESFFHRLDDSFLVPDDKRGSKYPIFGTLEEEKEYHKQ
FPTIYHLRKQLAESNEKADLRLVYLALAHMIKYRGHFLIDDPKFKVQNNDIQGLFEKFVEEYDNVQ
ETSLSKIKLNVTEILTANIPKSEKQEQLLKNYPSEKKNTLFGNLIGLALGLTPNFKTNFSLENDAKLQI
SSESYEEDLGSLLALIGENFIELFSAVKNLSDGILLAGIVSDESPHAPLSTKMVIRFKEHEEDLAALKH
FIKANLPEKYDEVFSDDSKNGYAGYVGVDSKVRKRNGKLATEEEFYKYLKEILNNLKGADYFLEK
IKREDLLRKQRTFDNGTIPYQVHLTEMKAIIHRQGEHYPFLKENKEKIEKILTFRIPYYVGPLARGNR
DFAWLTRNSDQAIRPWNFEEVVDKASSAEDFINKMTNYDLYLPEEKVLPKHSLLYETFAVYNELT
KVKFIAEGLRDYQFLDSGQKKQIVNQLFKEKRKVTEKDIIHYLHNVDGYDGIELKGIEKQFNASLST
YHDLLKIIKDKEFMDDPKNEEILENIVHTLTIFEDREMIKQRLAQYDSLFDEKVIKALTRRHYTGWG
KLSAKLINGICDKQTGKTILDYLIDDDKINRNFMQLINDDGLSFKEIIQKAQVVGKTDDVKQVVQEL
PGSPAIKKGILQSIKIVDELVKVMGHAPESIVIEMARENQTTARGKKNSQQRYKRIEDALKNLAPGL
DSNILKENPTDNIQLQNDRLFYYLQNGKDMYTGEALDINQLSNYDIDHIIPQAFIKDDSLDNRVLT
SSKDNRGKSDNVPSLEVVEKMKAFWQQLLDSKLISERKYNNLTKAERERGGLNELDKVGFIKRQL
VETRQITKHVAQILDARFNTEVNENNQKIRKVKIITLKSNLVSNFRKEFGLYKVREINDYHHAHDA
YLNAVVAKAILKKYPLEPEFVYGDYQKYDIKRYISRSKDPKEIEKATEKYFFYSNLLNFFKEEVH
YADGTIVKRENIEYSKDTGEIAWNKEKDFATVRKVLSCPQVNIVKKTEVQTGGFSKESILPKRNSD
KLIARKKDWDPKKYGGFDSPTVAYSVLVVAKVEKGKSKKLKSVKELVGITIMERSSFEKDPVDFL |

| SEQ ID NO | Nuclease Sequence |
|---|---|
| | EAKGYKEVRKDLIIKLPKYSLFELENGRKRMLASAGELQKGNELALPSKYVNFLYLASHYEKLKGS<br>PEDNEQKQLFVEQHKHYLDEIIEQISEFSKRVILADANLDKVLSAYNKHRDKPIREQAENIIHLFTLT<br>NLGAPAAFKYFDTTIDRKRYTSTKEVLDATLIHQSITGLYETRIDLSQLGGD |
| 247 | MKKPYSIGLDIGTNSVGWAVVTDDYKVPAKKMKVLGNTDKSHIKKNLLGALLFEGGETAEGRRL<br>KRTARRRYTRRRNRILYLQEIFATEMNKVDESFFHRLDDSFLVPEDKRGSKYPIFGTLEEEKEYHKQ<br>FPTIYHLRKQLAESNEKADLRLVYLALAHMIKYRGHFLIDDPKFKVQNNDIQGLFEKFVEEYDNVQ<br>ETSLSKIKLNVTEILTANIPKSEKQEQLLKNYPSEKKNTLFGNLIGLALGLTPNFKTNFSLENDAKLQI<br>SSESYEEDLGNLLALIGENFIELFSAVKNLSDGILLAGIVSDESPHAPLSTKMVIRFKEHEEDLAALK<br>HFIKANLPEKYDEVFSDDSKNGYAGYVGVDSKVRKRNGKLATEEEFYKYLKDILNNVKGADYFLE<br>KIKREDFLRKQRTFDNGTIPYQVHLQEMKAILHRQGEHYPFLKENKEKIEKILTFRIPYYVGPLARG<br>NRDFAWLTRNSDQAIRPWNFEEIVDKASSAEDFINKMTNYDLYLPEEKVLPKHSLLYETFAVYNEL<br>TKVKFIAEGLRDYQFLDSGQKKQIVNQLFKEKRKVTEKDIIHYLHNVDGYDGIELKGIEKQFNASLS<br>TYHDLLKIIKDKEFMDDPKNEEILENIVHTLTIFEDREMIKQRLAQYDSLFDEKVIKALTRRHYTGW<br>GKLSAKLINGIYDKQSQKTILDYLIDDDKINRNFMQLINDDGLSFKEIIQKAQVVGKTDDVKQVVQ<br>ELPGSPAIKKGILQSIKIVDELVKVMGHAPESIVIEMARENQTTARGKKNSQQRYKRIEDALKNLAP<br>GLDSNILKENPTDNVQLQNDRLFLYYLQNGRDMYTGKPLDINQLSNYDIDHIIPQAFIKDDSLDNRV<br>LTSSKDNRGKSDNVPSIEVVEKMKAFWQQLLDSKLISERKYNNLTKAERERGGLNELDKVGFIKR<br>QLVETRQITKHVAQILDARFNTEVNENNQKIRKVKIITLKSNLVSNFRKEFGLYKVREINDYHHAHD<br>AYLNAVVAKAILKKYPKLEPEFVYGDYQKYDLKRYISRSKDPKDIEKATEKYFFYSNLLNFFKEEV<br>HYADGTIIKRENIEYSKDTGEIAWNKEKDFATVRKVLSCPQVNIVKKTEVQTGGFSKESILPKRNSD<br>KLIARKKDWDPKKYGGFDSPTVAYSVLVVAKVEKGKSKKLKSVKELVGITIMERSSFEKDPVDFL<br>EAKGYKEVRKDLIIKLPKYSLFELENGRKRMLASAGELQKGNELALPSKYVNFLYLASHYEKLKGS<br>PEDNEQKQLFVEQHKHYLDEIIEQISEFSKRVILADANLDKVLSAYNKHRDKPIREQAENIIHLFTLT<br>NLGAPAAFKYFDTTIDRKRYTSTKEVLDATLIHQSITGLYETRIDLSQLGGD |
| 248 | MDKKYSIGLDIGTNSVGWAVITDDYKVPAKKMKVLGNTDKRTIKKNLLGALLFDSGETAEATRLK<br>RTARRRYTRRKNRLRYLQEIFSKEMSNVDANFFYRLEDSFLVPEDKQQERHPIFGNLVEEIEYHKEF<br>PTIYHLRKQLADSKEKADLRLIYLALAHMIKYRGHFLFEGDLSENTDVQRLFKDFVEVYDKTVEG<br>SYLSENLTNVTDVLVEKISKSRRLENILHYFPNEKKNGLFGNLALALGLQPNFKNNFDLAEEEAKL<br>QISKDTYEEELEVLLAQIGDNYAELFIATKELYDGILLAGILTVTDSSTKAPLSASMIERYENHQGDL<br>AKLKAFIRRFCKETYDEVFSDEVKDGYAGYIEGKTSQEDFYVHLKKLLANLEGADYFLEKINREDL<br>LRKQRTFDNGSIPYQIHLVEMRAILDKQAKFYPFLAKNQDRIEKLLTFRIPYYVGPLARGKSDFAWL<br>SRKSADKITPWNFDEIVDKESSAEAFINRMTNYDLYLPNQKVLPKHSLLYEKFTVYNELTKVKYKT<br>EQGKTAFFDANMKQEIFDGVFKVYRKVTKDKLMDFLEKEFDEFRIVDLMGLDKENKAFNASYGT<br>YHDLRKILDKDFLDNSDNEKILEDIVLTLTLFEDREMIRKRLEKYKDIFTEKQRKQLERRHYTGWG<br>RLSAKLIHGIRNKESRKTILDYLIDDGYSNRNFMQLINDDTLTFKEEIAKAQVVGETDSLKQFISELA<br>GSPAIKKGILQTVKIVDELVKVMGHKPENIVIEMARENQTTQKGQKNSQERMKRIEEGIKELGSQIL<br>KEHPVENTQLQNEKLYLYYLQNGRDMYVDQELDINRLSDYDIDHIIPQAFIKDDSIDNRVLTSSKD<br>NRGKSDNVPSEDVVKKMKNYWRQLLNAKLISQRKFDNLTKAERGGLSELDKVGFIKRQLVETRQI<br>TKHVAQILDSRMNTKYDENDKLIRDVKIITLKSKLVSDFRKDFQFYKVREINNYHHAHDAYLNAV<br>VGTALIKKYPKLESEFVYGDYKVYDVQKMIAKSEQEIGKATAKFFFYSNIMNFFKTEITLANGEIRK<br>RPMIETNEETGEIVWDKGRDFATVRKVLCMPQVNIVKKTEVQTGGFSKESILPKRNSDKLIARKKD<br>WDPKKYGGFDSPTVAYSVLVVAKVEKGKSKKLKSVKELVGITIMERSSFEKDPVDFLEAKGYKEV<br>RKDLIIKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDSTLIHQSITGLYETRIDLSQLGGD |
| 249 | MKKSYSIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHMIKFRGHFLIEGQLNAENTDVQTLFNDFVEVYDKTVE<br>ESHLSEITVDALSILTEKVSKSRRLENLVKCYPTEKKNTLFGNLIALSLGLQPNFKTNFKLSEDAKLQ<br>FSKDTYEEDLEELLGKIGDEYADLFASAKNLYDAILLSGILTVDDNTTKAPLSASMVKRYAEHHED<br>LEKLKEFVKANKPELYHDIFLDKDETKNGYAGYIENGVKQDEFYKYLKNTLSKIAGSDYFLDKIERED<br>FLRKQRTFDNGSIPHQIHLQEMHAILRRQGEYYPFLKENQAKIEKILTFRIPYYVGPLARKNSRFAW<br>AEYHSDEKITPWNFEEIVDKEESATAFIHRMTNNDLYLPEEKVLPKHSLIYEEFTVYNELTKVKYVT<br>DQGKAYYFDANMKQEIFDGVFKEHRKVTKDKLMNFLEKEFDEFRIVDLTGLDKENKSFNASLGTY<br>HDLKKILDKSFLDDKTNETIIEDIIQTLTLFEDRDMIRQRLQKYSDIFTPQQLKKLERRHYTGWGRLS<br>YKLINGIRNKENGKTILDYLIDDGYANRNFMQLINDDTLPFKQIIQEAQIIGDIDDIETVVHDLPGSPA<br>IKKKGILQSVKIVDELVKVMGHNPDNIVIEMARENQTTNRGRSQSQQRLKKLQESLKELGSNILNEEK<br>PSYVEDKVENSHLQNDKLFYYIQNGKDMYTGEELDIDHLSDYDIDHIIPQAFIKDNSIDNRVLTSS<br>AKNRGKSDDVPSLDIVHDRKADWIRLYKSGLISKRKFDNLTKAEHGGLTEDDKAGFIKRQLVETR<br>QITKHVAQILDSRENTERDENDKVIRDVKVITLKSNLVSQFRKDFELHKVREINDYHHAHDAYLNA<br>VIGNALLVKYPQLEPEFVYGKFKHFGHKENKATAKKFFYSNIMALFKKDVEYSDDTGEMVWNK<br>EKDFATVRKVLSCPQVNIVKKTEVQTGGFSKESILPKRNSDKLIARKKDWDPKKYGGFDSPTVAYS<br>VLVVAKVEKGKSKKLKSVKELLGITIMERSSFEKNPIDFLEAKGYKEVRKDLIIKLPKYSLFELENG<br>RKRMLASAGELQKGNELALPSKYVNFLYLASHYEKLKGSPEDNEQKQLFVEQHQYLDEIIEQISE<br>FSKRVILADANLDKVLSAYNKHRDKPIREQAENIIHLFTLTNLGAPAAFKYFDTTIDRKRYTSTKEV<br>LDATLIHQSITGLYETRIDLSQLGGD |
| 250 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS |

Sequences

| SEQ ID NO | Nuclease Sequence |
|---|---|
| | KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC<br>DKQTGKTILDYLIDDGFANRNFMQLINDDTLPFKQIIQKAQIVGDVDDIEQVVHNLPGSPAIKKGIL<br>QSIKIVDELVKVMGHNPDNIVIEMARENQTTNRGRSQSQQRLKKLQESLKELGSNILNEEKPSYVES<br>KVENSQLQNDRLFLYYIQNGKDMYTGEELDIDRLSDYDIDHIIPQAFIKDDSIDNRVLTSSAKNRGK<br>SDDVPSLEVVKKRKTYWHQLLKAKLISQRKFDNLTKAERGGLTEKDKAGFIKRQLVETRQITKHV<br>AQILDSRFNTKRDENDKVIRDVKVITLKSNLVSQFRKDFGFYKVREINDYHHAHDAYLNAVVGTA<br>LLKKYPKLAPEFVYGEYKKYDVRKIVRSKDESSLGKATAKMFFYSNLMNFFKKEVRLSDGTVIVR<br>PVIEYSKDTGEIAWNKEKDFATVRKVLSCPQVNIVKKTEVQTGGFSKESILPKRNSDKLIARKKDW<br>DPKKYGGFDSPTVAYSVLVVAKVEKGKSKKLKSVKELLGITIMERSSFEKNPIDFLEAKGYKEVRK<br>DLIIKLPKYSLFELENGRKRMLASAGELQKGNELALPSKYVNFLYLASHYEKLKGSPEDNEQKQLF<br>VEQHKHYLDEIIEQISEFSKRVILADANLDKVLSAYNKHRDKPIREQAENIIHLFTLTNLGAPAAFKY<br>FDTTIDRKRYTSTKEVLDATLIHQSITGLYETRIDLSQLGGD |
| 251 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC<br>DKQTGKTILDYLIDDGFANRNFMQLINDDTLPFKQIIQKAQIVGDVDDIEQVVHNLPGSPAIKKGIL<br>QSIKIVDELVKVMGHNPDNIVIEMARENQTTNRGRSQSQQRLKKLQESLKELGSNILNEEKPSYVES<br>KVENSQLQNDRLFLYYIQNGKDMYTGEELDIDRLSDYDIDHIIPQAFIKDDSIDNRVLTSSAKNRGK<br>SDDVPSLEVVKKRKTYWHQLLKAKLISQRKFDNLTKAERGGLTEKDKAGFIKRQLVETRQITKHV<br>AQILDSRFNTKRDENDKVIRDVKVITLKSNLVSQFRKDFGFYKVREINDYHHAHDAYLNAVVGTA<br>LLKKYPKLAPEFVYGEYKKYDVRKIVRSKDESSLGKATAKMFFYSNLMNFFKKEVRLSDGTVIVR<br>PVIEYSKDTGEIAWNKEKDFATVRKVLSCPQVNIVKKTEVQTGGFSKESILPKRNSDKLIPRKTEWD<br>PKKYGGFDSPTVAYSVLVVAKVEKGKSKKLKSVKELVGITIMERSSFEKDPVDFLEAKGYKEVRK<br>DLIIKLPKYSLFELENGRRRLLASAGELQKGNELALPSKYVNFLYLASHYEKLKGSPEDNEQKQLFV<br>EQHKHYLDEIVEQISEFSERVILADANLDKVLSAYNKNRDRPIREQAENIIHLFTLTNLGAPAAFKFF<br>DTTIDRKRYTSTKEVLDATLIHQSITGLYETRIDLSQLGGD |
| 252 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC<br>DKQTGKTILDYLIDDGFANRNFMQLINDDTLPFKQIIQKAQIVGDVDDIEQVVHNLPGSPAIKKGIL<br>QSIKIVDELVKVMGHNPDNIVIEMARENQTTNRGRSQSQQRLKKLQESLKELGSNILNEEKPSYVES<br>KVENSQLQNDRLFLYYIQNGKDMYTGEELDIDRLSDYDIDHIIPQAFIKDDSIDNRVLTSSAKNRGK<br>SDDVPSLEVVKKRKTYWHQLLKAKLISQRKFDNLTKAERGGLTEKDKAGFIKRQLVETRQITKHV<br>AQILDSRFNTKRDENDKVIRDVKVITLKSNLVSQFRKDFGFYKVREINDYHHAHDAYLNAVVGTA<br>LLKKYPKLAPEFVYGEYKKYDVRKIVRSKDESSLGKATAKMFFYSNLMNFFKKEVRLSDGTVIVR<br>PVIEYSKDTGEIAWNKEKDFATVRKVLSCPQVNIVKKTEVQTGGFSKESILPKRNSDKLIARKKDW<br>DPKKYGGFDSPTVAYSVLVVAKVEKGKSKKLKSVKELVGITIMERSSFEKDPVDFLEAKGYKEVR<br>KDLIIKLPKYSLFELENGRKRMLASAGELQKGNELALPSKYVNFLYLASHYEKLKGSPEDNEQKQL<br>FVEQHQHYLDEIIEQISEFSKRVILADANLDKVLSAYNKHRDKPIREQAENIIHLFTLTNLGAPAAFK<br>YFDTTIDRKRYTSTKEVLDATLIHQSITGLYETRIDLSQLGGD |
| 253 | MKKPYSIGLDIGTNSVGWAIVDDDYKVPAKKMRVFGDTDRSHIKKNLLGTLLFDSGETAESRRLK<br>RTARRRYTRRRNRILYLQEIFAEEMNKVDDSFFHRLEDSFLVEEDKQGSKYPIFGTLEEEKEYHKQF<br>PTIYHLRKQLAESNEKADLRLIYLALAHMIKYRGHFLIDDPKFKVQNNDIQGLFEKFVEEYDNVQE<br>TSLSKIKLNVTEILTANIPKSEKQEQLLKNYPSEKKNTLFGNLIGLALGLTPNFKTNFSLENDAKLQIS<br>SESYEEDLGNLLALIGENFIELFSAVKNLSDGILLAGIVSDESPHAPLSTKMVIRFKEHEEDLAALKH<br>FIKANLPEKYDEVFSDSKNGYAGYVGVDSKVRKRNGKLATEEEFYKYLKDILNNVKGADYFLEK<br>IKREDFLRKQRTFDNGSIPYQVHLTEMKAILQRQGEHYPFLKENKEKIEKILTFRIPYYVGPLARGNR<br>DFAWLTRNSDQAIRPWNFEEVVDKASSAEDFINKMTNYDLYLPEEKVLPKHSLLYETFAVYNELT<br>KVKFIAEGLRDYQFLDSGQKQIVNQLFKEKRKVTEKDIIHYLHNVDGYDGIELKGIEKQFNASLST<br>YHDLLKIIKDKEFMDDPKNEEILENIVHTLTIFEDREMIKQRLAQYDSIFDEKVIKALTRRHYTGWG<br>KLSAKLINGICDKKTGKTILDYLIDDGKINRNFMQLINDDGLSFKEIIQKAQVVGKTDDVKQVVQEL<br>PGSPAIKKGILQSIKIVDELVKVMGHAPESIVIEMARENQTTARGKKNSQQRYKRIEDALKNLAPGL |

| SEQ ID NO | Nuclease Sequence |
|---|---|
| | DSNILKENPTDNIQLQNDRLFLYYLQNGKDMYTGEPLDINQLSSYDIDHIIPQAFIKDDSLDNRVLTS<br>SKDNRGKSDNVPSIEVVQKRKAFWQQLLDSKLISERKFNNLTKAERGGLDERDKVGFIKRQLVETR<br>QITKHVAQILDARFNTEVDENNQKIREVKIITLKSNLVSNFRKEFGLYKVREINDYHHAHDAYLNA<br>VVAKAILKKYPKLEPEFVYGDYQKYDIKRYISRSKDPKDIEKATEKYFFYSNLLNFFKEEVHYADG<br>TIIKRENIEYSKDTGEIAWNKEKDFATVRKVLSCPQVNIVKKTEVQTGGFSKESILPKRNSDKLIPRK<br>TEWDPKKYGGFDSPTVAYSVLVVAKVEKGKSKKLKSVKELVGITIMERSSFEKDPVDFLEAKGYK<br>EVRKDLIIKLPKYSLFELENGRRRLLASAGELQKGNELALPSKYVNFLYLASHYEKLKGSPEDNEQ<br>KQLFVEQHKHYLDEIVEQISEFSERVILADANLDKVLSAYNKNRDRPIREQAENIIHLFTLTNLGAPA<br>AFKFFDTTIDRKRYTSTKEVLDATLIHQSITGLYETRIDLSQLGGD |
| 254 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC<br>DKQTGKTILDYLIDDGFANRNFMQLINDDTLPFKQIIQKAQIVGVDVDDIEQVVHNLPGSPAIKKGIL<br>QSIKIVDELVKVMGHNPDNIVIEMARENQTTNRGRSQSQQRLKKLQESLKELGSNILNEEKPSYVES<br>KVENSQLQNDRLFLYYIQNGKDMYTGEELDIDRLSDYDIDHIIPQAFIKDDSIDNRVLTSSAKNRGK<br>SDDVPSLEVVKKRKTYWHQLLKAKLISQRKFDNLTKAERGGLTEKDKAGFIKRQLVETRQITKHV<br>AQILDSRFNTKRDENDKVIRDVKVITLKSNLVSQFRKDFGFYKVREINDYHHAHDAYLNAVVGTA<br>LLKKYPKLAPEFVYGEYKKYDVRKIVRSKDESSLGKATAKMFFYSNLMNFFKKEVRLSDGTVIVR<br>PVIEYSKDTGEIAWNKEKDFATVRKVLSCPQVNIVKKTEVQTGGFSKESILPKRNSDKLIARKKDW<br>DPKKYGGFDSPTVAYSVLVVAKVEKGKSKKLKSVKELVGITIMERSSFEKDPVDFLEAKGYKEVR<br>KDLIIKLPKYSLFELENGRKRMLASAGELQKGNELALPSKYVNFLYLASHYEKLKGSPEDNEQKQL<br>FVEQHKHYLDEIIEQISEFSKRVILADANLDKVLSAYNKHRDRPIREQAENIIHLFTLTNLGAPAAFK<br>YFDTTIDRKRYTSTKEVLDATLIHQSITGLYETRIDLSQLGGD |
| 255 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC<br>DKQTGKTILDYLIDDGFANRNFMQLINDDTLPFKQIIQKAQIVGVDVDDIEQVVHNLPGSPAIKKGIL<br>QSIKIVDELVKVMGHNPDNIVIEMARENQTTNRGRSQSQQRLKKLQESLKELGSNILNEEKPSYVES<br>KVENSQLQNDRLFLYYIQNGKDMYTGEELDIDRLSDYDIDHIIPQAFIKDDSIDNRVLTSSAKNRGK<br>SDDVPSLEVVKKRKTYWHQLLKAKLISQRKFDNLTKAERGGLTEKDKAGFIKRQLVETRQITKHV<br>AQILDSRFNTKRDENDKVIRDVKVITLKSNLVSQFRKDFGFYKVREINDYHHAHDAYLNAVVGTA<br>LLKKYPKLAPEFVYGEYKKYDVRKIVRSKDESSLGKATAKMFFYSNLMNFFKKEVRLSDGTVIVR<br>PVIEYSKDTGEIAWNKEKDFATVRKVLSCPQVNIVKKTEVQTGGFSKESILPKRNSDKLIARKKDW<br>DPKKYGGFDSPTVAYSVLVVAKVEKGKSKKLKSVKELVGITIMERSSFEKDPIDFLEAKGYKEVRK<br>DLIIKLPKYSLFELENGRKRMLASAGELQKGNELALPSKYVNFLYLASHYEKLKGSPEDNEQKQLF<br>VEQHKHYLDEIIEQISEFSKRVILADANLDKVLSAYNKHRDKPIREQAENIIHLFTLTNLGAPAAFKY<br>FDTTIDRKRYTSTKEVLDATLIHQSITGLYETRIDLSQLGGD |
| 256 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC<br>DKQTGKTILDYLIDDGFANRNFMQLINDDTLPFKQIIQKAQIVGVDVDDIEQVVHNLPGSPAIKKGIL<br>QSIKIVDELVKVMGHNPDNIVIEMARENQTTNRGRSQSQQRLKKLQESLKELGSNILNEEKPSYVES<br>KVENSQLQNDRLFLYYIQNGKDMYTGEELDIDRLSDYDIDHIIPQAFIKDDSIDNRVLTSSAKNRGK<br>SDDVPSLEVVKKRKTYWHQLLKAKLISQRKFDNLTKAERGGLTEKDKAGFIKRQLVETRQITKHV<br>AQILDSRFNTKRDENDKVIRDVKVITLKSNLVSQFRKDFGFYKVREINDYHHAHDAYLNAVVGTA<br>LLKKYPKLAPEFVYGEYKKYDVRKIVRSKDESSLGKATAKMFFYSNLMNFFKKEVRLSDGTVIVR<br>PVIEYSKDTGEIAWNKEKDFATVRKVLSCPQVNIVKKTEVQTGGFSKESILPKRNSDKLIPRKTEWD<br>PKKYGGFDSPIVAYSVLVVAKVEKGKSKKLKPVKELVGITIMERSSFEKDPVDFLEAKGYKEVRKD<br>LIIKLPKYSLFELENGRKRMLASAGELQKGNELALPSKYVNFLYLASHYEKLKGSPEDNEQKQLFV |

| SEQ ID NO | Nuclease Sequence |
|---|---|
| | EQHKHYLDEIVEQISEFSERVILADANLDKILSAYNKHRDKPIREQAENIINLFTFTNLGAPAAFKFF<br>DTDIDRKRYTSTKEVLDATLIHQSITGLYETRIDLSQLGGD |
| 257 | MKKPYSIGLDIGTNSVGWAVVTDDYKVPAKKMKVLGNTDKSHIKKNLLGALLFDSGETAEGRRL<br>KRTARRRYTRRRNRILYLQEIFAEEMNKIDESFFHRLDDSFLVPEDKRGSKYPIFATLEEEKEYHKK<br>FPTIYHLRKHLAESNEKADLRLVYLALAHMIKYRGHFLIDDPKFKVQNNDIQGLFEKFVEEYDNVQ<br>ETSLSKIKLNVTEILTANIPKSEKQEQLLKNYPSEKKNTLFGNLIGLALGLTPNFKTNFSLENDAKLQI<br>SSESYEEDLGNLLALIGENFIELFSAVKNLSDGILLAGIVSDESPHAPLSTKMVIRFKEHEEDLAALK<br>HFIKANLPEKYDEVFSDDSKNGYAGYVGVDSKVRKRNGKLATEEEFYKYLKDILNNVKGADYFLE<br>KIKREDLLRKQRTFDNGTIPYQVHLSEMKAIIHRQGEHYPFLKENKEKIEKILTFRIPYYVGPLARGN<br>RDFAWLTRNSDQAIRPWNFEEIVDKASSAEDFINKMTNYDLYLPEEKVLPKHSLLYETFAVYNELT<br>KVKFIAEGLRDYQFLDSGQKKQIVNQLFKEKRKVTEKDIIHYLHNVGYDGIELKGIEKQFNASLST<br>YHDLLKIIKDKEFMDDPKNEEILENIVHTLTIFEDREMIKQRLAQYDSLFDEKVIKALTRRHYTGWG<br>KLSAKLINGIYDKQSKKTILDYLIDDGEINRNFMQLIHDDGLSFKEIIQKAQVFGKTDDVKQVVQEL<br>PGSPAIKKGILQSIKIVDELVKVMGHAPESIVIEMARENQTTARGKKNSQQRYKRIEDSLKNLASGL<br>DSNILKENPTDNVQLQNDRLFLYYLQNGKDMYTGEALDINQLSNYDIDHIIPQAFIKDDSLDNRVLT<br>SSKDNRGKSDNVPSIEVVEKMKAFWQQLLDSKLISERKYNNLTKAERERGGLNELDKVGFIKRQL<br>VETRQITKHVAQILDARFNTEVNENNQKIRKVKIITLKSNLVSNFRKEFGLYKVREINDYHHAHDA<br>YLNAVVAKAILKKYPKLEPEFVYGDYQKYDIKRYISRSKDPKDIEKATEKYFFYSNLLNFFKEEVH<br>YADGTIIKRENIEYSKDTGEIAWNKEKDFATVRKVLSCPQVNIVKKTEVQTGGFSKESILPKRNSDK<br>LIPRKTEWDPKKYGGFDSPTVAYSVLVVAKVEKGKSKKLKSVKELVGITIMERSSFEKDPVDFLEA<br>KGYKEVRKDLIIKLPKYSLFELENGRRRLLASAGELQKGNELALPSKYVNFLYLASHYEKLKGSPE<br>DNEQKQLFVEQHKYLDEIVEQISEFSERVILADANLDKVLSAYNKNRDRPIREQAENIIHLFTLTNL<br>GAPAAFKFFDTTIDRKRYTSTKEVLDATLIHQSITGLYETRIDLSQLGGD |
| 258 | MKKPYSIGLDIGTNSVGWAVITDDYKVPAKKMKVLGNTDKSHIKKNLLGALLFDSGNTAEDRRLK<br>RTARRRYTRRRNRILYLQEIFAEEMNKIDESFFHRLDDSFLVPEDKRGSKYPIFATLEEEKEYHKQFP<br>TIYHLRKKLAESNEKADLRLIYLALAHMIKYRGHFLIDDPKFKVQNNDIQGLFEKFVEEYDNVQET<br>SLSKIKLNVTEILTANIPKSEKQEQLLKNYPSEKKNTLFGNLIGLALGLTPNFKTNFSLENDAKLQISS<br>ESYEEDLGNLLALIGENFIELFSAVKNLSDGILLAGIVSDESPHAPLSTKMVIRFKEHEEDLAALKHFI<br>KANLPEKYDEVFSDDSKNGYAGYVGVDSKVRKRNGKLATEEEFYKYLKEILNNVKGADYFLEKI<br>KREDFLRKQRTFDNGTIPYQVHLAEMRAILHRQGDYYPFLKDNKEKIEKILTFRIPYYVGPLARGNR<br>DFAWLTRNSDQAIRPWNFEEVVDKASSAEDFINKMTNYDLYLPEEKVLPKHSLLYETFAVYNELT<br>KVKFIAEGLRDYQFLDSGQKKQIVNQLFKEKRKVTEKDIIQFLHNVGYDGIELKGIEKQFNASLST<br>YHDLLKIIKDKEFMDDPKNEEILENIVHTLTIFEDREMIKQRLAQYDSLFDEKVIKALTRRHYTGWG<br>KLSAKLINGIRDKQSNKTILDYLIDDDKINRNFMQLINDDGLSFKDIIQKAQVVGKTDDVKQVVQEL<br>PGSPAIKKGILQSIKIVDELVKVMGHAPESIVIEMARENQTTARGKKNSQQRYKRIEDALKNLAPGL<br>DSNILKENPTDNIQLQNDRLFLYYLQNGKDMYTGESLDINQLSNYDIDHIVPQAFIKDDSLDNRVLT<br>SSKDNRGKSDNVPSLEVVQKRKAFWQQLLDSKLISERKENNLTKAERGGLDERDKVGFIKRQLVE<br>TRQITKHVAQILDARFNTEVNEKNQKIRKVKIITLKSNLVSNFRKEFRLYKVREINDYHHAHDAYL<br>NAVVAKAILKKYPKLEPEFVYGDYQKYDIKRYISKSKDPKDIEKATQKYFFYSNLLNFFKEEVHYA<br>DGTIVKRENVEYSKDTGEIAWNKEKDFATVRKVLSCPQVNIVKKTEVQTGGFSKESILPKRNSDKLI<br>PRKTEWDPKKYGGFDSPTVAYSVLVVAKVEKGKSKKLKSVKELVGITIMERSSFEKDPVDFLEAK<br>GYKEVRKDLIIKLPKYSLFELENGRRRLLASAGELQKGNELALPSKYVNFLYLASHYEKLKGSPED<br>NEQKQLFVEQHKYLDEIVEQISEFSERVILADANLDKVLSAYNKNRDRPIREQAENIIHLFTLTNLG<br>APAAFKFFDTTIDRKRYTSTKEVLDATLIHQSITGLYETRIDLSQLGGD |
| 259 | MDKKYSIGLDIGTNSVGWAVITDDYKVPAKKMKVLGNTDKRTIKKNLLGALLFDSGETAEATRLK<br>RTARRRYTRRKNRLRYLQEIFSKEMSNVDANFFYRLEDSFLVPEDKQQERHPIFGNLVEEIEYHKEF<br>PTIYHLRKQLADSKEKADLRLIYLALAHMIKYRGHELFEGDLKSENTDVQRLFKDFVEVYDKTVEG<br>SYLSENLTNVTDVLVEKISKSRRLENILHYFPNEKKNGLFGNFLALALGLQPNFKNNFDLAEEEAKL<br>QISKDTYEEELEVLLAQIGDNYAELFIATKELYDGILLAGILTVTDSSTKAPLSASMIERYENHQGDL<br>AKLKAFIRRFCKETYDEVFSDEVKDGYAGYIEGKTSQEDFYVHLKKLLANLEGADYFLEKINREDL<br>LRKQRTFDNGSIPYQIHLVEMRAILDKQAKFYPFLAKNQDRIEKLLTFRIPYYVGPLARGKSDFAWL<br>SRKSADKITPWNFDEIVDKESSAEAFINRMTNYDLYPNQKVLPKHSLLYEKFTVYNELTKVKYKT<br>EQGKTAFFDANMKQEIFDGVFKVYRKVTKDKLMDFLEKEFDEFRIVDLMGLDKENKAFNASYGT<br>YHDLRKILDKDFLDNSDNEKILEDIVLTLTLFEDREMIRKRLEKYKDIFTEKQRKQLERRHYTGWG<br>RLSAKLIHGIRNKESRKTILDYLIDDGYSNRNFMQLINDDTLTFKEEIAKAQVVGETDSLKQFISELA<br>GSPAIKKGILQTVKIVDELVKVMGHKPENIVIEMARENQTTQKGQKNSQERMKRIEEGIKELGSQIL<br>KEHPVENTQLQNEKLYLYYLQNGRDMYVDQELDINRLSDYDIDHIIPQAFIKDDSIDNRVLTSSKD<br>NRGKSDNVPSEDVVKKMKNYWRQLLNAKLISQRKFDNLTKAERGGLSELDKVGFIKRQLVETRQI<br>TKHVAQILDSRMNTKYDENDKLIRDVKIITLKSKLVSDFRKDFQFYKVREINNYHHAHDAYLNAV<br>VGTALIKKYPKLESEFVYGDYKVYDVQKMIAKSEQEIGKATAKFFFYSNIMNFFKTEITLANGEIRK<br>RPMIETNEETGEIVWDKGRDFATVRKVLCMPQVNIVKKTEVQTGGFSKESILPKRNSDKLIARKKD<br>WDPKKYGGFDSPTVAYSVLVVAKVEKGKSKKLKSVKELVGITIMERSSFEKDPVDFLEAKGYKEV<br>RKDLIIKLPKYSLFELENGRRKMLASAGELQKGNELALPSKYVNFLYLASHYEKLKGSPEDNEQKQ<br>LFVEQHQHYLDEIIEQISEFSKRVILADANLDKVLSAYNKHRDKPIREQAENIIHLFTLTNLGAPAAF<br>KYFDTTIDRKRYTSTKEVLDSTLIHQSITGLYETRIDLSQLGGD |
| 260 | MKKPYSIGLDIGTNSVGWAVVTDDYKVPAKKMKVLGDTDKSHIKKNLLGTLLFESGETAEGRRLK<br>RTARRRYTRRRNRILYLQEIFAEEMNKVDDSFFQRLDESFLKDDDKNFDSHPIFGNKAEEDAYHQK<br>FPTIYHLRQYLADSPEKADLRLVYLALAHIIKYRGHELFEGDLKSENKDVQHLFNDFVEMFDKTVE<br>GSYLSENLPNVADVLVEKVSKSRRLENVLHYFPNEKKNGLFGNFIALALGLQPNFKTNFKLSEDAK<br>LQFSKDTYDEDLEELLGKIGDDYADLFVAAKNLYDAILLSGILTVTDPTTKAPLSASMIDRYEKHQ |

| SEQ ID NO | Nuclease Sequence |
|---|---|
| | KDLALLKNLIKKNLTQEKYDEVFSDESKNGYAGYINGKVKQEEFYKYLKNTLSKIEGSDYFLDKIE<br>REDFLRKQRTFDNGSIPHQIHLQEMNAIIRRQGEHYPFLKENKEKIEKILTFRIPYYVGPLARGNRDF<br>AWLTRNSDQAIRPWNFEEIVDQASSAEDFINKMTNYDLYLPEEKVLPKHSLLYETFAVYNELTKVK<br>FIAEGLRDYQFLDSGQKKQIVNQLFKEKRKVTEKDIIQYLHNVDGYDGIELKGIEKQFNASLSTYHD<br>LLKIIKDKEFMDDPKNEEILENIVHTLTIFEDREMIKQRLAQYDSLFDEKVIKALTRRHYTGWGKLS<br>AKLINGIYDKQSKKTILDYLIDDGEINRNFMQLINDDGLSFKDIIQKAQVVGKTNDVKQVVQELPGS<br>PAIKKGILQSIKLVDELVKVMGHAPESIVIEMARENQTTARGKKNSQQRYKRIEDALKNLAPGLDS<br>NILKENPTDNIQLQNDRLFLYYLQNGKDMYTGEALDINQLSNYDIDHIVPQAFIKDDSLDNRVLTSS<br>KDNRGKSDNVPSIEVVQKRKAFWQQLLDSKLISERKFNNLTKAERGGLDERDKVGFIKRQLVETR<br>QITKHVAQILDARFNTEVDENNQRIRKVKIITLKSNLVSNFRKEFGLYKVREINDYHHAHDAYLNA<br>VVAKAILKKYPKLEPEFVYGDYQKYDLKRYISRSKDPKDIEKATEKYFFYSNLLNFFKEEVHYADG<br>TIIKRENIEYSNDTGEIAWNKEKDFATVRKVLSCPQVNIVKKTEVQTGGFSKESILPKRNSDKLIPRK<br>KDWDPKKYGGFDSPTVAYSVLVVAKVEKGKSKKLKPVKELVGITIMERSSFEKDPVDFLEAKGYK<br>EVRKDLIIKLPKYSLFELENGRKRMLASAGELQKGNELALPSKYVNFLYLASHYEKLKGSPEDNEQ<br>KQLFVEQHKHYLDEIIEQISEFSERVILADANLDKVLSAYNNHRDKPIREQAENIIHLFTLTNLGAPA<br>AFKFFDTTIDRKRYTSTKEVLDATLIHQSITGLYETRIDLSKLGGD |
| 261 | MKKPYSIGLDIGTNSVGWAVVTDDYKVPAKKMKVLGNTNKESIKKNLIGALLFDAGNTAADRRL<br>KRTARRRYTRRRNRILYLQEIFAEEMNKVDESFFHRLDDSFLVPEDKRGSKYPIFATLEEEKEYHKK<br>FPTIYHLRKHLADSKEKADLRLIYLALAHMIKYRGHFLYEESFDIKNNDIQKIFNEFISIYDNTFEGSS<br>LSGQNAQVEAIFTDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIQNNLQEKYDEVFSDQSKDGYAGYIDKTTQEAFYKYIKNLLSKLEGADYFLDKIEREDFL<br>RKQRTFDNGSIPHQIHLQEMNAIIRRQGEHYPFLKENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEG<br>MRDYQFLDSGQKKKIVSQLFEDKRKVTEKDIIHYLHTIDGYDGIELSGIEKQFNASLSTYHDLLKIIK<br>DKAFLDDSENEAIIEEIIHTLTIFEDREMIKQRLAQYADIFDKSVLKKLARRHYTGWGKLSAKLINGI<br>RDKQSNKTILDYLIDDGKINRNFMQLINDDSLSFKETIQKAQVVGDTDDVKQVVQELPGSPAIKKGI<br>LQSIKLVDELVKVMGHNPDNIVIEMARENQTTNRGRSQSQQRKKLQDSLKELGSNILNEEKPSYIE<br>DKVENSHLQNDQLFLYYIQNGKDMYTGEELDIDHLSDYDIDHIIPQAFIKDDSIDNRVLTSSAKNRG<br>KSDDVPSLDIVRERKADWIRLYKSKLISKRKFDNLTKAERGGLTEADKAGFIKRQLVETRQITKHV<br>AQILDSRFNTKRDENDKVIRDVKVITLKSNLVSQFRKDFELYKVREINDYHHAHDAYLNAVVGTA<br>LLKKYPKLAPEFVYGEYKKYDIRKFRITSSKDKATAKYFFYSNLMNFFKRIIRYSNGKIVVRPVVEYS<br>KDTGEIAWNKEKDFATVRKVLSCPQVNIVKKTEVQTGGFSKESILPKRNSDKLIARKKDWDPKKY<br>GGFDSPTVAYSVLVVAKVEKGKSKKLKSVKELVGITIMERSSFEKNPIDFLEAKGYKEVRKDLIIKL<br>PKYSLFELENGRKRMLASAGELQKGNELALPSKYVNFLYLASHYEKLKGSPEDNEQKQLFVEQHK<br>HYLDEIIEQISEFSKRVILADANLDKVLSAYNKHRDKPIREQAENIIHLFTLTNLGAPAAFKYFDTTID<br>RKRYTSTKEVLDATLIHQSITGLYETRIDLSQLGGD |
| 262 | MKKPYSIGLDIGTNSVGWAVVTDDYKVPAKKMKVLGDTDKSHIKKNLLGTLLFESGETAEGRRLK<br>RTARRRYTRRRNRILYLQEIFAEEMNKIDDSFFQRLDESFLKDDDKNFDSHPIFGNKAEEDAYHQKF<br>PTIYHLRQYLADSPEKADLRLVYLALAHIIKYRGHELFEGDLKSENKDVQHLFNDFVEMEDKTVEG<br>SYLSENLPNVADVLVEKVSKSRRLENVLHYFPNEKKNGLFGNFIALALGLQPNFKTNFKLSEDAKL<br>QFSKDTYDEDLEELLGKIGDDYADLFVAAKNLYDAILLSGILTVTDPTTKAPLSASMIDRYEKHQK<br>DLALLKNLIKQNLTQEKYDEVFSDESKNGYAGYINGKVKQEEFYKYLKNTLSKIEGSDYFLDKIER<br>EDFLRKQRTFDNGSIPHQIHLQEMNAIIRRQGEHYPFLKENKEKIEKILTFRIPYYVGPLARGNRDFA<br>WLTRNSDQAIRPWNFEEIVDQASSAEDFINKMTNYDLYLPEEKVLPKHSLLYETFAVYNELTKVKF<br>IAEGLRDYQFLDSGQKKQIVNQLFKEKRKVTEKDIIQYLHNVDGYDGIELKGIEKQFNASLSTYHDL<br>LKIIKDKEFMDDPKNEEILENIVHTLTIFEDREMIKQRLAQYDSLFDEKVIKALTRRHYTGWGKLSA<br>KLINGIYDKQSKKTILDYLIDDGEINRNFMQLINDDGLSFKEIIQKAQVVGKTNDVKQVVQELPGS<br>AIKKGILQSIKLVDELVKVMGHAPESIVIEMARENQTTARGKKNSQQRYKRIEDALKNLAPGLDSNI<br>LKENPTDNIQLQNDRLFLYYLQNGKDMYTGEALDINQLSNYDIDHIVPQAFIKDDSLDNRVLTSSK<br>DNRGKSDNVPSIEVVQKRKAFWQQLLDSKLISERKFNNLTKAERGGLDERDKVGFIKRQLVETRQI<br>TKHVAQILDARFNTEVDENNQRIRKVKIITLKSNLVSNFRKEFGLYKVREINDYHHAHDAYLNAVV<br>AKAILKKYPKLEPEFVYGDYQKYDLKRYISRSKDPKDIEKATEKYFFYSNLLNFFKEEVHYADGTII<br>KRENIEYSNDTGEIAWNKEKDFATVRKVLSCPQVNIVKKTEVQTGGFSKESILPKRNSDKLIPRKKD<br>WDPKKYGGFDSPTVAYSVLVVAKVEKGKSKKLKPVKELVGITIMERSSFEKDPVDFLEAKGYKEV<br>RKDLIIKLPKYSLFELENGRKRMLASAGELQKGNELALPSKYVNFLYLASHYEKLKGSPEDNEQKQ<br>LFVEQHKHYLDEIVEQISEFSERVILADANLDKVLSAYNNHRDKPIREQAENIIHLFTLTNLGAPAAF<br>KFFDTTIDRKRYTSTKEILDATLIHQSITGLYETRIDLSQLGGD |
| 263 | MNKPYSIGLDIGTNSVGWSVVDDDYKVPAKKMRVFGDTDKGHIKKNLLGTLLFDSGETAESRRLK<br>RTARRRYTRRRNRILYLQEIFAKEMAKVDESFFHRLDESFLTDDKTFDSHPIFGNKAEEDAYHQKVEG<br>FPTIYHLRKHLADSTEKADLRLVYLALAHMIKFRGHFLIEGELNAENTDVQKLFADFVGVYDRTFD<br>DSHLSEITVDASSILTEKISKSRRLEKLIKHYPTEKKNTLFGNLVALALGLQPNFKTNFKLSEDAKLQ<br>FSKDTYEEDLEELLGKIGDDYADLFTSAKNLYDAILLSGILTVDDESTKAPLSASMIKRYAEHHEDL<br>EKLKEFVKANKPELYHDIFKDEAKNGYAGYIENGVKQDEFYKYLKSTLSKQDGSQYFLDKIEREDF<br>LRKQRTFDNGSIPHQLHLKEMRSILHRQGEYYPFLKENQAKIEKILTFRIPYYVGPLARKDSRFAWA<br>EYHSDEPITPWNFDEVVDKEKSAEKFITRMTLNDLYLPEEKVLPKHSHVYETYTVYNELTKVKYV<br>NEQGEAKFFDANMKQEIFDHVFKENRKVTKDKLMNFLGKEFDEFRIVDITGLDKENKAFNASLGT<br>YHDLKKILDKSFLDDKVNETIIEDIIQTLTLFEDKDMIRQRLQKYSDIFTPQQLKKLERRHYTGWGR<br>LSYKLINGIRDKQTGKTILDYLIDDGYANRNFMQLINDDSLPFKEIIQKAQIIGDIDDIKAVHDLPGS<br>PAIKKGILQSVKIVDELVKVMGHNPDNIVIEMARENQTTNRGRTQSQQRLKKLQESLKELGSNILNE<br>KKPSYVEDKVENSHLQNDRLFLYYIQNGKDMYTGDELDIDHLSDYDIDHIIPQAFIKDDSIDNRVLT |

| SEQ ID NO | Nuclease Sequence |
|---|---|
| | SSAKNRGKSDDVPSIEIVRDRKADWMRLRKAGLISKRKFDNLTKAERGGLTEADKAGFIKRQLVET<br>RQITKHVAQILDNRFNTERDENDKVIRDVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEVKLANG<br>EIRKRPLIETNEETGEIVWNKEKDFATVRKVLSCPQVNIVKKTEVQTGGFSKESILPKRNSDKLIPRK<br>NGWDPKKYGGFDSPTVAYSVLVVAKVEKGKSKKLKTVKELVGITIMERSSFEKDPVDFLEAKGYK<br>EVQKDLIIKLPKYSLFELENGRKRMLASAGELQKGNELALPSKYVNFLYLASHYEKLKGSPEDNEQ<br>KQLFVDQHKHYLDEIIEQISDFSKRVILADANLDKVLSAYNNHRDKPVREQAENIINLFTLTNLGAP<br>AAFKFFDTTIDRKRYTSTKEILDATLIHQSITGLYETRIDLSQLGGD |
| 264 | MTKPYSIGLDIGTNSVGWAVITDSYKVPSKKMKVLGNTSKKYVKKNLLGVLLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC<br>DKQTGKTILDYLIDDGFANRNFMQLINDDTLPFKQIIQKAQIVGVDDIEQVVHNLPGSPAIKKGIL<br>QSIKIIDELVKVMGHNPDNIVIEMARENQTTNRGRSQSQQRLKLQESLKELGSNILNEEKPSYVES<br>KVENSQLQNDRLFLYYIQNGKDMYTGEELDIDRLSDYDIDHIIPQAFIKDDSIDNRVLTSSAKNRGK<br>SDDVPSLEVVKKRKTYWHQLLKSKLISQRKFDNLTKAERGGLTEKDKAGFIKRQLVETRQITKHV<br>AQILDSRFNTKRDENDKVIRDVKVITLKSNLVSQFRKDFGFYKVREINDYHHAHDAYLNAVVGTA<br>LLKKYPKLAPEFVYGEYKKYDVRKIVRSKDESSLGKATAKMFFYSNLMNFFKKEVRLSDGTVIVR<br>PVIEYSKDTGEIAWNKEKDFATVRKVLSCPQVNIVKKTEVQTGGFSKESILPKRNSDKLIPRKKGW<br>DPKKYGGFDSPTVAYSVLVVAKVEKGKSKKLKSVKELVGITIMERSSFEKDPIDFLEAKGYKEVRK<br>DLIIKLPKYSLFELENGRKRMLASAGELQKGNELALPSKYVNFLYLASHYEKLKGSPEDNEQKQLF<br>VEQHKHYLDEIIEQISEFSERVILADANLDKILSAYNKHRDKPIREQAENIIHLFTLTNLGAPAAFKFF<br>DTTIDRKRYTSTKEVLDATLIHQSITGLYETRIDLSQLGGD |
| 265 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC<br>DKQTGKTILDYLIDDGFANRNFMQLINDDTLPFKQIIQKAQIVGVDDIEQVVHNLPGSPAIKKGIL<br>QSIKIVDELVKVMGHNPDNIVIEMARENQTTNRGRSQSQQRLKKLQESLKELGSNILNEEKPSYVES<br>KVENSQLQNDRLFLYYIQNGKDMYTGEELDIDRLSDYDIDHIIPQAFIKDDSIDNRVLTSSAKNRGK<br>SDDVPSLEVVKKRKTYWHQLLKAKLISQRKFDNLTKAERGGLTEKDKAGFIKRQLVETRQITKHV<br>AQILDSRFNTKRDENDKVIRDVKVITLKSNLVSQFRKDFGFYKVREINDYHHAHDAYLNAVVGTA<br>LLKKYPKLAPEFVYGEYKKYDVRKIVRSKDESSLGKATAKMFFYSNLMNFFKKEVRLSDGTVIVR<br>PVIEYSKDTGEIAWNKEKDFATVRKVLSCPQVNIVKKTEVQTGGFSKESILPKRNSDKLIPRKKGW<br>DPKKYGGFDSPTVAYSVLVVAKVEKGKSKKLKSVKELVGITIMERSSFEKDPVDFLEAKGYKEVRK<br>DLIIKLPKYSLFELENGRKRMLASAGELQKGNELALPSKYVNFLYLASHYEKLKGSPEDNEQKQL<br>FVEQHKHYLDEIVEQISEFSERVILADANLDKVLSAYNKNRDRPIREQAENIIHLFTLTNLGAPAAFK<br>FFNTDIDRKRYTSTKEILDATLIHQSITGLYETRIDLSQLGGD |
| 266 | MKKPYSIGLDIGTNSVGWAVVTDDYKVPAKKMKVLGDTDKSHIKKNLLGTLLFESGETAEGRRLK<br>RTARRRYTRRRNRILYLQEIFAEEMNKIDDSFFQRLDESFLKDDDKNFDSHPIFGNKAEEDAYHQKF<br>PTIYHLRQYLADSPEKADLRLVYLALAHIIKYRGHELFEGDLKSENKDVQHLFNDFVEMEDKTVEG<br>SYLSENLPNIADVLVEKVSKSRRLENVLHYFPNEKKNGLFGNFIALALGLQPNFKTNFKLSEDAKL<br>QFSKDTYDEDLEELLGKIGDDYADLFVAAKNLYDAILLSGILTVTDPTTKAPLSASMIDRYEKHHK<br>DLALLKNLIKQNLTQEKYDEVFSDESKNGYAGYINGKVKQEEFYKYLKNTLSKIEGSDYFLDKIER<br>EDFLRKQRTFDNGSIPHQIHLQEMNAIIRRQGEHYPFLKENKEKIEKILTFRIPYYVGPLARGNRDFA<br>WLTRNSDQAIRPWNFEEIVDQASSAEDFINKMTNYDLYLPEEKVLPKHSLLYETFAVYNELTKVKF<br>IAEGLRDYQFLDSGQKKQIVNQLFKEKRKVTEKDIIQYLHNVDGYDGIELKGIEKQFNASLSTYHDL<br>LKIIKDKEFMDDPKNEEILENIVHTLTIFEDREMIKQRLAQYDSLFDEKVIKALTRRHYTGWGKLSA<br>KLINGIYDKQSKKTILDYLIDDGEINRNFMQLINDDGLSFKEIIQKAQVVGKTNDVKQVVQELPGSP<br>AIKKGILQSIKLVDELVKIMGHAPESIVIEMARENQTTARGKKNSQQRYKRIEDALKNLAPGLDSNI<br>LKENPTDNIQLQNDRLFLYYLQNGKDMYTGEALDINQLSNYDIDHIVPQAFIKDDSLDNRVLTSSK<br>DNRGKSDNVPSIEVVQKRKAFWQQLLDSKLISERKENNLTKAERGGLDERDKVGFIKRQLVETRQI<br>TKHVAQILDARFNTEVDENNQRIRKVKIITLKSNLVSNFRKEFGLYKVREINDYHHAHDAYLNAVV<br>AKAILKKYPKLEPEFVYGDYQKYDLKRYISRSKDPKDIEKATEKYFFYSNLLNFFKEEVHYADGTII<br>KRENIEYSNDTGEIAWNKEKDFAIVRKVLSCPQVNIVKKTEVQTGGFSKESILPKRNSDKLIPRKKN<br>WDPKKYGGFDSPTVAYSVLVVAKVEKGKSKKLKPVKELVGITIMERSSFEKNPIDFLEAKGYKEV<br>RKDLIIKLPKYSLFELENGRKRMLASAGELQKGNELALPSKYVNFLYLASHYEKLKGSPEDNEQKQ<br>LFVEQHKHYLDEIIEQISEFSERVILADANLDKVLSAYNKHRDKPIREQAENIIHLFTLTNLGAPAAF<br>KFFDTTIDRKRYTSTKEVLNATLIHQSITGLYETRIDLSKLGGD |

| SEQ ID NO | Nuclease Sequence |
|---|---|
| 267 | MKKPYSIGLDIGTNSVGWAVVTDDYKVPAKKMKVLGNTNKESIKKNLIGALLFDAGNTAADRRL<br>KRTARRRYTRRRNRILYLQEIFAEEMNKVDESFFHRLDDSFLVPEDKRGSKYPIFATLEEEKEYHKK<br>FPTIYHLRKHLADSKEKADLLIYLALAHMIKYRGHFLYEESFDIKNNDIQKIFNEFISIYDNTFEGSS<br>LSGQNAQVEAIFTDKISKSAKRERVLKLFPDEKSTGLFSEFLKIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIQNNLQEKYDEVFSDQSKDGYAGYIDGKTTQEAFYKYIKNLLSKLEGADYFLDKIEREDFL<br>RKQRTFDNGSIPHQIHLQEMNAIIRRQGEHYPFLKENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEG<br>MRDYQFLDSGQKKKIVSQLFEDKRKVTEKDIIHYLHTIDGYDGIELSGIEKQFNASLSTYHDLLKIIK<br>DKAFLDDSENEAIIEEIIHTLTIFEDREMIKQRLAQYADIFDKSVLKKLARRHYTGWGKLSAKLINGI<br>RDKQSNKTILDYLIDDGKINRNFMQLINDDSLSFKETIQKAQVVGDTDDVKQVVQELPGSPAIKKGI<br>LQSIKIVDELVKVMGHNPDNIVIEMARENQTTNRGRSQSQQRLKKLQDSLKELGSNILNEEKPSYIE<br>DKVENSHLQNDQLFLYYIQNGKDMYTGEELDIDHLSDYDIDHIIPQAFIKDDSIDNRVLTSSAKNRG<br>KSDDVPSLDIVRERKADWIRLYKSKLISKRKFDNLTKAERGGLTEADKAGFIKRQLVETRQITKHV<br>AQILDSRFNTKRDENDKVIRDVKVITLKSNLVSQFRKDFELYKVREINDYHHAHDAYLNAVVGTA<br>LLKKYPKLAPEFVYGEYKKYDIRKFITSSKDKATAKYFFYSNLMNFFKRIIRYSNGKIVVRPVVEYS<br>KDTGEIAWNKEKDFATVRKVLSCPQVNIVKKTEVQTGGFSKESILPKRNSDKLIPRKKGWDPKKY<br>GGFDSPTVAYSVLVVAKVEKGKSKKLKSVKELVGITIMERSSFEKDPVDFLEAKGYKEVRKDLIIK<br>LPKYSLFELENGRKRMLASAGELQKGNELALPSKYVNFLYLASHYEKLKGSPEDNEQKQLFVEQH<br>KHYLDEIVEQISEFSERVILADANLDKVLSAYNKNRDRPIREQAENIIHLFTLTNLGAPAAFKFENTD<br>IDRKRYTSTKEILDATLIHQSITGLYETRIDLSQLGGD |
| 268 | MKKSYSIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHMIKFRGHFLIEGQLNAENTDVQTLFNDFVEVYDKTVE<br>ESHLSEITVDALSILTEKVSKSRRLENLVKCYPTEKKNTLFGNLIALSLGLQPNFKTNFKLSEDAKLQ<br>FSKDTYEEDLEELLGKIGDEYADLFASAKNLYDAILLSGILTVDDNTTKAPLSASMVKRYAEHHED<br>LEKLKEFVKANKPELYHDIFDETKNGYAGYIENGVKQDEFYKYLKNTLSKIAGSDYFLDKIERED<br>FLRKQRTFDNGSIPHQIHLQEMHAILRRQGEYYPFLKENQAKIEKILTFRIPYYVGPLARKNSRFAW<br>AEYHSDEKITPWNFEEIVDKEESATAFIHRMTNNDLYLPEEKVLPKHSLIYEEFTVYNELTKVKYVT<br>DQGKAYYFDANMKQEIFDGVFKEHRKVTKDKLMNFLEKEFDEFRIVDLTGLDKENKSFNASLGTY<br>HDLKKILDKSFLDDKTNETIIEDIIQTLTLFEDRDMIRQRLQKYDIFTPQQLKKLERRHYTGWGRLS<br>YKLINGIRNKENGKTILDYLIDDGYANRNFMQLINDDTLPFKQIIQEAQIIGDIDDIETVVHDLPGSPA<br>IKKGILQSVKIVDELVKVMGHNPDNIVIEMARENQTTNRGRSQSQQRLKKLQESLKELGSNILNEEK<br>PSYVEDKVENSHLQNDKLFLYYIQNGKDMYTGEELDIDHLSDYDIDHIIPQAFIKDNSIDNRVLTSS<br>AKNRGKSDDVPSLDIVHDRKADWIRLYKSGLISKRKFDNLTKAEHGGLTEDDKAGFIKRQLVETR<br>QITKHVAQILDSRENTERDENDKVIRDVKVITLKSNLVSQFRKDFELHKVREINDYHHAHDAYLNA<br>VIGNALLVKYPQLEPEFVYGKFKHFHGHKENKATAKKFFYSNIMALFKKDVEYSDDTGEMVWNK<br>EKDFATVRKVLSCPQVNIVKKTEVQTGGFSKESILPKRNSDKLIARKKDWDPKKYGGFDSPTVAYS<br>VLVVAKVEKGKSKKLKSVKELVGITIMERSSFEKDPIDFLEAKGYKEVRDLIIKLPKYSLFELENG<br>RKRMLASAGELQKGNELALPSKYVNFLYLASHYEKLKGSPEDNEQKQLFVEQHKHYLDEIIEQISE<br>FSKRVILADANLDKVLSAYNKHRDKPIREQAENIIHLFTLTNLGAPAAFKYFDTTIDRKRYTSTKEV<br>LDSTLIHQSITGLYETRIDLSQLGGD |
| 269 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKIVGNQADFKKHFDLEEKAPLQFS<br>KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC<br>DKQTGKTILDYLIDDGFANRNFMQLINDDTLPFKQIIQKAQIVGDVDDIEQVVHNLPGSPAIKKGIL<br>QSIKIVDELVKVMGHNPDNIVIEMARENQTTNRGRSQSQQRLKKLQESLKELGSNILNEEKPSYIES<br>KVENSHLQNDRLFLYYIQNGKDMYTGEELDIDRLSDYDIDHIIPQAFIKDDSIDNRVLTSSAKNRGK<br>SDDVPSLEVVRRKRKTYWHQLLKSKLISQRKFDNLTKAERGGLTEKDKAGFIKRQLVETRQITKHV<br>AQILDSRFNTKRDENDKVIRDVKVITLKSNLVSQFRKDFGFYKVREINDYHHAHDAYLNAVVGTA<br>LLKKYPKLAPEFVYGEYKKYDVRKIVRSKDESSLGKATAKMFFYSNLMNFFKKEVRLSDGTVIVR<br>PVIEYSKDTGEIAWNKEKDFATVRKVLSCPQVNIVKKTEVQTGGFSKESILPKRNSDKLIPRKKNW<br>DPKKYGGFDSPTVAYSVLVVAKVEKGKSKKLKPVKELVGITIMERSSFEKDPVDFLEAKGYKEVR<br>EDLIIKLPKYSLFELENGRKRLLASAGELQKGNELALPSKYVNFLYLASHYEKLKGSPEDNEQKQLF<br>VEQHKHYLDEIVEQISEFSERVILADANLDKILSAYNKHRDKPIREQAENIIHLFTLTNLGAPAAFKF<br>FDTTIDRKRYTSTKEVLDATLIHQSITGLYETRIDLSKLGGD |
| 270 | MKKPYSIGLDIGTNSVGWAVVDDDYKVPAKKMRVFGDTDRSHIKKNLLGTLLFDDGNTAESRRL<br>KRTARRRYTRRRNRILYLQEIFAEEMNKVDESFFHRLDDSFLVPEDKRGSKYPIFATLEEEKEYHKK<br>FPTIYHLRKHLADSKEKTDLRLIYLALAHMIKYRGHFLYEESFDIKNNDIQKIFNEFISLYDNTFEGSS<br>LSGQNAQVEAIFTDKISKSAKRERVLKLFPDEKSTGLFSEFLKIVGNQADFKKHFDLEEKAPLQFS<br>KDTYDEDLENLLGQIGDDFADLFLVAKKLYDAILLSGILTVTDPSTKAPLSASMIERYENHEEDLAA<br>LKQFVKANLPEKYDEVFSDQSKDGYAGYIDGKTTQEAFYKYIKNLLSKLEGADYFLDKIEREDFLR<br>KQRTFDNGSIPHQIHLQEMNAILRRQGEHYPFLKDNKEKIEKILTFRIPYYVGPLARGNRDFAWLTR |

| SEQ ID NO | Nuclease Sequence |
|---|---|
| | NSDQAIRPWNFEEVVDKASSAEDFINKMTNYDLYLPEEKVLPKHSLLYETFAVYNELTKVKFIAEG<br>LRDYQFLDSGQKKQIVNQLFKTKRKVTEKDIINYLHKVDGYDGVEISGVEDRFNASLGTYHDLLKI<br>IKDKSFLDDKKNEEIIEDIVLTLTLFEDRDMIRQRLQKYSDIFTPQQLKKLERRHYTGWGRLSYKLIN<br>GIRNKENNKSILDYLIDDGYANRNFMQLINDDTLPFKQIIQKSQVVGDIDDIKTVVHDLPGSPAIKK<br>GILQSVKIVDELVKVMGHNPDNIVIEMARENQTTNRGRSQSQQRLKKLQESLKELGSNILNVEKPS<br>YIEDKVENNHLQNDKLFLYYIQNGKDMYTGEELDIDHLSDYDIDHIIPQAFIKDDSIDNRVLTSSAK<br>NRGKSDDVPSLDIVRGRKAEWIRLYKAKLISQRKFDNLTKAERGGLTENDKAGFIKRQLVETRQIT<br>KHVAQILDARFNTKRDENDKLIREVKVITLKSNLVSQFRKEFGFYKVREINDYHHAHDAYLNAVV<br>GTAILKKYPKLTSEFVYGEYKKYDIRKFIKSDDHSEMGKATAKYFFYSNLLNFFKEEIKYANGKIVV<br>RPVVEYSKDTGEIAWNKEKDFATVRKVLSCPQVNIVKKTEVQTGGFSKESILPKRNSDKLIARKKD<br>WDPKKYGGFDSPTVAYSVLVVAKVEKGKSKKLKSVKELVGITIMERSSFEKDPIDFLEAKGYKEV<br>RKDLIIKLPKYSLFELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENIIHLFTLTNLGAPAAF<br>KYFDTTIDRKRYTSTKEVLDATLIHQSITGLYETRIDLSQLGGD |
| 271 | MKKPYSIGLDIGTNSVGWAVVTDDYKVPSKKMKVLGNTDKSHIKKNLLGALLFESGETAEGRRLK<br>RTARRRYTRRRNRILYLQEIFAEEMNKIDESFFHRLDDSFLVPEDKRGSKYPIFATLQEEKEYHKQFP<br>TIYHLRKQLAESNEKADLRLVYLALAHMIKYRGHFLIDDPKFKVQNNDIQGLFEKFVEEYDNVQET<br>SLSKIKLNVTEILTANIPKSEKQEQLLKNYPSEKKNTLFGNLIGLALGLTPNFKTNFSLENDAKLQISS<br>ESYEEDLGNLLALIGENFIELFSAVKNLSDGILLAGIVSDESPHAPLSTKMVIRFKEHEEDLAALKHFI<br>KANLPEKYDEVFSDDSKNGYAGYVGVDSKVRKRNGKLATEEEFYKYLKDILNNVKGADYFLEKI<br>KREDFLRKQRTFDNGTIPYQVHLTEMRAIIHRQGEHYPFLQENKEKIEKILTFRIPYYVGPLARGNR<br>DFAWLTRNSDQAIRPWNFEEVVDKASSAEDFINKMTNYDLYLPEEKVLPKHSLLYETFAVYNELT<br>KVKFIAEGLRDYQFLDSGQKKQIVNQLFKEKRKVTEKDIIHYLHNVDGYDGIELKGIEKQFNASLST<br>YHDLLKIIKDKEFMDDAKNEEILENIVHTLTIFEDREMIKQRLAQYDSLFDEKVIKALTRRHYTGWG<br>KLSAKLINGIYDKQSKKTILDYLIDDDKINRNFMQLINDDGLSFKDIIQKAQVVGKTNDVKQVVQE<br>LPGSPAIKKGILQSIKIVDELVKVMGHAPESIVIEMARENQTTARGKKNSQQRYKRIEDALKNLAPG<br>LDSNILKENPTDNIQLQNDRLFLYYLQNGKDMYTGEPLDINQLSSYDIDHIVPQAFIKDDSLDNRVL<br>TSSKDNRGKSDNVPSLEVVQKRKAFWQQLLDSKLISEHKFNNLTKAERGGLDERDKVGFIKRQLV<br>ETRQITKHVAQILDARFNTEVNEKKQKIRSVKIITLKSNLVSNFRKEFRLYKVREINDYHHAHDAYL<br>NAVVAKAILKKYPKLEPEFVYGDYQKYDIKRYISRSKDPKEVEKATQKYFFYSNLLNFFKEEVHYA<br>DGTIIKRENIEYSKDTGEIAWNKEKDFATVRKVLSCPQVNIVKKTEVQTGGFSKESILPKRNSDKLIP<br>RKTEWDPKKYGGFDSPIVAYSVLVVAKVEKGKSKKLKPVKELVGITIMERSSFEKDPVDFLEAKG<br>YKEVRKDLIIKLPKYSLFELENGRKRMLASAGELQKGNELALPSKYVNFLYLASHYEKLKGSPEDN<br>EQKQLFVEQHKHYLDEIVEQISEFSERVILADANLDKILSAYNKHRDKPIREQAENIINLFTFTNLGA<br>PAAFKFFDTDIDRKRYTSTKEVLDATLIHQSITGLYETRIDLSQLGGD |
| 272 | MKKSYSIGLDIGTNSVGWAVVDDDYKVPAKKMRVFGDTDRSHIKKNLLGTLLFDEGNTAESRRL<br>KRTARRRYTRRRNRILYLQEIFATEMNKVDESFFHRLDDSFLVPEDKRGSKYPIFATLEEEKEYHKQ<br>FPTIYHLRKQLAESNEKADLRLVYLALAHMIKYRGHFLIDDPKFKVQNNDIQGLFEKFVEEYDNVQ<br>ETSLSKIKLNVTEILTANIPKSEKQEQLLKNYPSEKKNTLFGNLIGLALGLTPNFKTNFSLENDAKLQI<br>SSESYEEDLGNLLALIGENFIELFSAVKNLSDGILLAGIVSDESPHAPLSAKMVIRFKEHEEDLAALK<br>HFIKANLPEKYDEVFSDDSKNGYAGYVGVDSKVRKRNGKLATEEEFYKYLKEILNNVKGADYFLE<br>KIKREDFLRKQRTFDNGTIPYQVHLTEMRAILHRQGEYYPFLKENKEKIEKILTFRIPYYVGPLARG<br>NRDFAWLTRNSDQAIRPWNFEEVVDKASSAEDFINKMTNYDLYLPEEKVLPKHSLLYETFAVYNE<br>LTKVKFIAEGLRDYQFLDSGQKKQIVNQLFKEKRKVTEKDIIHYLHNVDGYDGIELKGIEKQFNASL<br>STYHDLLKIIKDKEFMDDPKNEEILENIVHTLTIFEDREMIKQRLAQYDSLFDEKVIKALTRRHYTG<br>WGKLSAKLINGIYDKQSKKTILDYLIDDDKINRNFMQLINDDGLSFKEIIQKAQVVGKTDDVKQVV<br>QELPGSPAIKKGILQSIKIVDELVKVMGHAPESIVIEMARENQTTARGKKNSQQRYKRIEDALKNLA<br>PGLDSNILKENPTDNIQLQNDRLFLYYLQNGKDMYTGEELDINQLSNYDIDHIVPQAFIKDDSLDN<br>RVLTSSKDNRGKSDNVPSLEVVQKRKAFWQQLLDSKLISERKENNLTKAERGGLDERDKVGFIRRQ<br>LVETRQITKHVAQILDARFNTEVTENNQKIRKVKIITLKSNLVSNFRKEFGLYKVREINDYHHAHDA<br>YLNAVVAKAILKKYPKLEPEFVYGDYQKYDIKRYISRSKDPKEVEKATEKYFFYSNLLNFFKEEVH<br>YADGTIVKRENIEYSKDTGEIAWNKEKDFATVRKVLSCPQVNIVKKTEVQTGGFSKESILPKRNSD<br>KLIARKKDWDPKKYGGFDSPTVAYSVLVVAKVEKGKSKKLKSVKELLGITIMERSSFEKNPIDFLE<br>AKGYKEVRKDLIIKLPKYSLFELENGRKRMLASAGELQKGNELALPSKYVNFLYLASHYEKLKGSP<br>EDNEQKQLFVEQHKHYLDEIIEQISEFSKRVILADANLDKVLSAYNKHRDKPIREQAENIIHLFTLTN<br>LGAPAAFKYFDTTIDRKRYTSTKEVLDATLIHQSITGLYETRIDLSQLGGD |
| 273 | MDKKYSIGLDIGTNSVGWAVITDDYKVPAKKMKVLGNTDKRTIKKNLLGALLFDSGETAEATRLK<br>RTARRRYTRRKNRLRYLQEIFSKEMSNVDANFFYRLEDSFLVPEDKQQERHPIFGNLVEEIEYHKEF<br>PTIYHLRKQLADSKEKADLRLIYLALAHMIKYRGHFLFEGDLKSENTDVQRLFKDFVEVYDKTVEG<br>SYLSENLTNVTDVLVEKISKSRRLENILHYFPNEKKNGLFGNLPLALALGLQPNFKNNFDLAEEAKL<br>QISKDTYEEELEVLLAQIGDNYAELFIATKELYDGILLAGILTVTDSSTKAPLSASMIERYENHQGDL<br>AKLKAFIRRFCKETYDEVFSDEVKDGYAGYIEGKTSQEDFYVHLKKLLANLEGADYFLEKINREDL<br>LRKQRTFDNGSIPYQIHLVEMRAILDKQAKFYPFLAKNQDRIEKLLTFRIPYYVGPLARGKSDFAWL<br>SRKSADKITPWNFDEIVDKESSAEAFINRMTNYDLYLPNQKVLPKHSLLYEKFTVYNELTKVKYKT<br>EQGKTAFFDANMKQEIFDGVFKVYRKVTKDKLMDFLEKEFDEFRIVDLMGLDKENKAFNASYGT<br>YHDLRKILDKDFLDNSDNEKILEDIVLTLTLFEDREMIRKRLEKYKDIFTEKQRKQLERRHYTGWG<br>RLSAKLIHGIRNKESRKTILDYLIDDGYSNRNFMQLINDDTLTFKEEIAKAQVVGETDSLKQFISELA<br>GSPAIKKGILQTVKIVDELVKVMGHKPENIVIEMARENQTTQKGQKNSQERMKRIEEGIKELGSQIL<br>KEHPVENTQLQNEKLYLYYLQNGRDMYVDQELDINRLSDYDIDHIIPQAFIKDDSIDNRVLTSSKD<br>NRGKSDNVPSEDVVKKMKNYWRQLLNAKLISQRKFDNLTKAERGGLSELDKVGFIKRQLVETRQI<br>TKHVAQILDSRMNTKYDENDKLIRDVKIITLKSKLVSDFRKDFQFYKVREINNYHHAHDAYLNAV |

-continued

Sequences

| SEQ ID NO | Nuclease Sequence |
|---|---|
|  | VGTALIKKYPKLESEFVYGDYKVYDVQKMIAKSEQEIGKATAKFFFYSNIMNFFKTEITLANGEIRK<br>RPMIETNEETGEIVWDKGRDFATVRKVLCMPQVNIVKKTEVQTGGFSKESILPKRNSDKLIARKKD<br>WDPKKYGGFDSPTVAYSVLVVAKVEKGKSKKLKSVKELVGITIMERSSFEKDPVDFLEAKGYKEV<br>RKDLIIKLPKYSLFELENGRKRMLASAGELQKGNELALPSKYVNFLYLASHYEKLKGSPEDNEQKQ<br>LFVEQHQHYLDEIIEQISEFSKRVILADANLDKVLSAYNKHRDKPIREQAENIIHLFTLTNLGAPAAF<br>KYFDTTIDRKRYTSTKEVLDATLIHQSITGLYETRIDLSQLGGD |
| 274 | MKKPYSIGLDIGTNSVGWAVVTDDYKVPAKKMKVLGDTDKSHIKKNLLGTLLFESGETAEGRRLK<br>RTARRRYTRRRNRILYLQEIFAEEMNKVDDSFFQRLDESFLKDDDKNFDSHPIFGNKAEEDAYHQK<br>FPTIYHLRQYLADSPEKADLRLVYLALAHIIKYRGHELFEGDLKSENKDVQHLFNDFVEMFDKTVE<br>GSYLSENLPNVADVLVEKVSKSRRLENVLHYFPNEKKNGLFGNFIALALGLQPNFKTNFKLSEDAK<br>LQFSKDTYDEDLEELLGKIGDDYADLFVAAKNLYDAILLSGILTVTDPTTKAPLSASMIDRYEKHH<br>KDLALLKNLIKQNLTQEKYDEVFSDESKNGYAGYISGKVKQEEFYKYLKNTLSKIEGSDYFLDKIE<br>REDFLRKQRTFDNGSIPHQIHLQEMNAIIRRQGEHYPFLKENKEKIEKILTFRIPYYVGPLARGNRDF<br>AWLTRNSDQAIRPWNFEEIVDQASSAEDFINKMTNYDLYLPEEKVLPKHSLLYETFAVYNELTKVK<br>FIAEGLRDYQFLDSGQKKQIVNQLFKEKRKVTEKDIIQYLHNVDGYDGIELKGIEKQFNASLSTYHD<br>LLKIIKDKEFMDDPKNEEILENIVHTLTIFEDREMIKQRLAQYDSLFDEKVIKALTRRHYTGWGKLS<br>AKLINGIYDKQSKKTILDYLIDDGEINRNFMQLINDDGLSFKDIIQKAQVVGKTNDVKQVVQELPGS<br>PAIKKGILQSIKLVDELVKVMGHAPESIVIEMARENQTTARGKKNSQQRYKRIEDALKNLAPGLDS<br>NILKENPTDNIQLQNDRLFYYLQNGKDMYTGEALDINQLSNYDIDHIVPQAFIKDDSLDNRVLTSS<br>KDNRGKSDNVPSIEVVQKRKAFWQQLLDSKLISERKENNLTKAERGGLDERDKVGFIKRQLVETR<br>QITKHVAQILDARFNTEVDENNQRIRKVKIITLKSNLVSNFRKEFGLYKVREINDYHHAHDAYLNA<br>VVAKAILKKYPKLEPEFVYGDYQKYDLKRYISRSKDPKDIEKATEKYFFYSNLLNFFKEEVHYADG<br>TIIKRENIEYSNDTGEIAWNKEKDFATVRKVLSCPQVNIVKKTEVQTGGFSKESILPKRNSDKLIARK<br>KDWPKKYGGFDSPTVAYSVLVVAKVEKGKSKKLKSVKELLGITIMERSSFEKNPIDFLEAKGYKE<br>VRKDLIIKLPKYSLFELENGRKRMLASAGELQKGNELALPSKYVNFLYLASHYEKLKGSPEDNEQK<br>QLFVEQHKHYLDEIIEQISEFSKRVILADANLDKVLSAYNKHRDKPIREQAENIIHLFTLTNLGAPAA<br>FKYFDTTIDRKRYTSTKEVLDATLIHQSITGLYETRIDLSQLGGD |
| 275 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC<br>DKQTGKTILDYLIDDGFANRNFMQLINDDTLPFKQIIQKAQIVGDVDDIEQVVHNLPGSPAIKKGIL<br>QSIKIVDELVKVMGHNPDNIVIEMARENQTTNRGRSQSQQRLKKLQESLKELGSNILNEEKPSYVES<br>KVENSQLQNDRLFLYYIQNGKDMYTGEELDIDRLSDYDIDHIIPQAFIKDDSIDNRVLSTKAAKNRGK<br>SDDVPSLEVVKKRKTYWHQLLKAKLISQRKFDNLTKAERGGLTEKDKAGFIKRQLVETRQITKHV<br>AQILDSRFNTKRDENDKVIRDVKVITLKSNLVSQFRKDFGFYKVREINDYHHAHDAYLNAVVGTA<br>LLKKYPKLAPEFVYGEYKKYDVRKIVRSKDESSLGKATAKMFFYSNLMNFFKKEVRLSDGTVIVR<br>PVIEYSKDTGEIAWNKEKDFATVRKVLSCPQVNIVKKTEVQTGGFSKESILPKRNSDKLIARKKDW<br>DPKKYGGFDSPTVAYSVLVVAKVEKGKSKKLKSVKELVGITIMERSSFEKNPIDFLEAKGYKEVR<br>DLIIKLPKYSLFELENGRKRMLASAGELQKGNELALPSKYVNFLYLASHYEKLKGSPEDNEQKQLF<br>VEQHKHYLDEIIEQISEFSKRVILADANLDKVLSAYNKHRDKPIREQAENIIHLFTLTNLGAPAAFKY<br>FDTTIDRKRYTSTKEVLDATLIHQSITGLYETRIDLSQLGGD |
| 276 | MKKPYSIGLDIGTNSVGWAVVTDDYKVPSKKMKVLGNTDKSHIKKNLLGALLFESGETAEGRRLK<br>RTARRRYTRRRNRILYLQEIFAEEMNKIDESFFHRLDDSFLVPEDKRGSKYPIFATLQEEKEYHKQFP<br>TIYHLRKQLAESNEKADLRLVYLALAHMIKYRGHFLIDDPKFKVQNNDIQGLFEKFVEEYDNVQET<br>SLSKIKLNVTEILTANIPKSEKQEQLLKNYPSEKKNTLFGNLIGLALGLTPNFKTNFSLENDAKLQISS<br>ESYEEDLGNLLALIGENFIELFSAVKNLSDGILLAGIVSDESPHAPLSTKMVIRFKEHEEDLAALKHFI<br>KANLPEKYDEVFSDDSKNGYAGYVGVDSKVRKRNGKLATEEEFYKLYKDILNNVKGADYFLEKI<br>KREDFLRKQRTFDNGTIPYQVHLTEMRAIIHRQGEHYPFLQENKEKIEKILTFRIPYYVGPLARGNR<br>DFAWLTRNSDQAIRPWNFEEVVDKASSAEDFINKMTNYDLYLPEEKVLPKHSLLYETFAVYNELT<br>KVKFIAEGLRDYQFLDSGQKKQIVNQLFKEKRKVTEKDIIHYLHNVDGYDGIELKGIEKQFNASLST<br>YHDLLKIIKDKEFMDDAKNEEILENIVHTLTIFEDREMIKQRLAQYDSLFDEKVIKALTRRHYTGWG<br>KLSAKLINGIYDKQSKKTILDYLIDDDKINRNFMQLINDDGLSFKDIIQKAQVVGKTNDVKQVVQE<br>LPGSPAIKKGILQSIKLVDELVKVMGHAPESIVIEMARENQTTARGKKNSQQRYKRIEDALKNLAPG<br>LDSNILKENPTDNIQLQNDRLFYYLQNGKDMYTGEPLDINQLSSYDIDHIVPQAFIKDDSLDNRVL<br>TSSKDNRGKSDNVPSLEVVQKRKAFWQQLLDSKLISEHKFNNLTKAERGGLDERDKVGFIKRQLV<br>ETRQITKHVAQILDARFNTEVNEKKQKIRSVKIITLKSNLVSNFRKEFRLYKVREINDYHHAHDAYL<br>NAVVAKAILKKYPKLEPEFVYGDYQKYDIKRYISRSKDPKEVVEKATQKYFFYSNLLNFFKEEVHYA<br>DGTIIKRENIEYSKDTGEIAWNKEKDFATVRKVLSCPQVNIVKKTEVQTGGFSKESILPKRNSDKLIA<br>RKKDWPKKYGGFDSPTVAYSVLVVAKVEKGKSKKLKSVKELLGITIMERSSFEKNPIDFLEAKG<br>YKEVRKDLIIKLPKYSLFELENGRKRMLASAGELQKGNELALPSKYVNFLYLASHYEKLKGSPEDN<br>EQKQLFVEQHKHYLDEIIEQISEFSKRVILADANLDKVLSAYNKHRDKPIREQAENIIHLFTLTNLGA<br>PAAFKYFDTTIDRKRYTSTKEVLDATLIHQSITGLYETRIDLSQLGGD |

| SEQ ID NO | Nuclease Sequence |
|---|---|
| 277 | MKKPYSIGLDIGTNSVGWAVVTDDYKVPAKKMKVLGNTNKESIKKNLIGALLFDAGNTAADRRL<br>KRTARRRYTRRRNRILYLQEIFAEEMNKVDESFFHRLDDSFLVPEDKRGSKYPIFATLEEEKEYHKK<br>FPTIYHLRKHLADSKEKADLRLIYLALAHMIKYRGHFLYEESFDIKNNDIQKIFNEFISIYDNTFEGSS<br>LSGQNAQVEAIFTDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIQNNLQEKYDEVFSDQSKDGYAGYIDKTTQEAFYKYIKNLLSKLEGADYFLDKIEREDFL<br>RKQRTFDNGSIPHQIHLQEMNAIIRRQGEHYPFLKENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEG<br>MRDYQFLDSGQKKKIVSQLFEDKRKVTEKDIIHYLHTIDGYDGIELSGIEKQFNASLSTYHDLLKIIK<br>DKAFLDDSENEAIIEEIIHTLTIFEDREMIKQRLAQYADIFDKSVLKKLARRHYTGWGKLSAKLINGI<br>RDKQSNKTILDYLIDDGKINRNFMQLINDDSLSFKETIQKAQVVGDTDDVKQVVQELPGSPAIKKGI<br>LQSIKIVDELVKVMGHNPDNIVIEMARENQTTNRGRSQSQQRLKKLQDSLKELGSNILNEEKPSYIE<br>DKVENSHLQNDQLFLYYIQNGKDMYTGEELDIDHLSDYDIDHIIPQAFIKDDSIDNRVLTSSAKNRG<br>KSDDVPSLDIVRERKADWIRLYKSKLISKRKFDNLTKAERGGLTEADKAGFIKRQLVETRQITKHV<br>AQILDSRFNTKRDENDKVIRDVKVITLKSNLVSQFRKDFELYKVREINDYHHAHDAYLNAVVGTA<br>LLKKYPKLAPEFVYGEYKKYDIRKFITSSKDKATAKYFFYSNLMNFFKRIIRYSNGKIVVRPVVEYS<br>KDTGEIAWNKEKDFATVRKVLSCPQVNIVKKTEVQTGGFSKESILPKRNSDKLIARKKDWDPKKY<br>GGFDSPTVAYSVLVVAKVEKGKSKKLKSVKELLGITIMERSSFEKNPIDFLEAKGYKEVRKDLIIKL<br>PKYSLFELENGRKRMLASAGELQKGNELALPSKYVNFLYLASHYEKLKGSPEDNEQKQLFVEQHK<br>HYLDEIIEQISEFSKRVILADANLDKVLSAYNKHRDKPIREQAENIIHLFTLTNLGAPAAFKYFDTTID<br>RKRYTSTKEVLDATLIHQSITGLYETRIDLSQLGGD |
| 278 | MKKSYSIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHMIKFRGHFLIEGQLNAENTDVQTLFNDFVEVYDKTVE<br>ESHLSEITVDALSILTEKVSKSRRLENLVKCYPTEKKNTLFGNLIALSLGLQPNFKTNFKLSEDAKLQ<br>FSKDTYEEDLEELLGKIGDEYADLFASAKNLYDAILLSGILTVDDNTTKAPLSASMVKRYAEHHED<br>LEKLKEFVKANKPELYHDIFKDETKNGYAGYIENGVKQDEFYKYLKNTLSKIAGSDYFLDKIERED<br>FLRKQRTFDNGSIPHQIHLQEMHAILRRQGEYYPFLKENQAKILTFRIPYYVGPLARKNSRFAW<br>AEYHSDEKITPWNFEEIVDKEESATAFIHRMTNNDLYLPEEKVLPKHSLIYEEFTVYNELTKVKYVT<br>DQGKAYYFDANMKQEIFDGVFKEHRKVTKDKLMNFLEKEFDEFRIVDLTGLDKENKSFNASLGTY<br>HDLKKILDKSFLDDKTNETIIEDIIQTLTLFEDRDMIRQRLQKYSDIFTPQQLKKLERRHYTGWGRLS<br>YKLINGIRNKENGKTILDYLIDDGYANRNFMQLINDDTLPFKQIIGEQEAQIIGDIDDDIETVVHDLPGSPA<br>IKKGILQSVKIVDELVKVMGHNPDNIVIEMARENQTTNRGRSQSQQRLKKLQESLKELGSNILNEEK<br>PSYVEDKVENSHLQNDKLFLYYIQNGKDMYTGEELDIDHLSDYDIDHIIPQAFIKDNSIDNRVLTSS<br>AKNRGKSDDVPSLDIVHDRKADWIRLYKSGLISKRKFDNLTKAEHGGLTEDDKAGFIKRQLVETR<br>QITKHVAQILDSRENTERDENDKVIRDVKVITLKSNLVSQFRKDFELHKVREINDYHHAHDAYLNA<br>VIGNALLVKYPQLEPEFVYGKFKHFHGHKENKATAKKFFYSNIMALFKKDVEYSDDTGEMVWNK<br>EKDFATVRKVLSCPQVNIVKKTEVQTGGFSKESILPKRNSDKLIPRKKGWDPKKYGGFDSPTVAYS<br>VLVVAKVEKGKSKKLKSVKELVGITIMERSSFEKDPVDFLEAKGYKEVRKDLIIKLPKYSLFELENG<br>RKRMLASAGELQKGNELALPSKYVNFLYLASHYEKLKGSPEDNEQKQLFVEQHKHYLDEIVEQIS<br>EFSERVILADANLDKVLSAYNKNRDRPIREQAENIIHLFTLTNLGAPAAFKFFNTDIDRKRYTSTKEI<br>LDATLIHQSITGLYETRIDLSQLGGD |
| 279 | MKKPYSIGLDIGTNSVGWAVVDDDYKVPAKKMRVFGDTDRSHIKKNLLGTLLFDDGNTAESRRL<br>KRTARRRYTRRRNRILYLQEIFAEEMNKVDESFFHRLDDSFLVEEDKRGSKYPIFATLEEEKEYHKK<br>FPTIYHLRKHLADSKEKTDLRLIYLALAHMIKYRGHFLYEESFDIKNNDIQKIFNEFISLYDNTFEGSS<br>LSGQNAQVEAIFTDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHEEDLAA<br>LKQFVKANLPEKYDEVFSDQSKDGYAGYIDKTTQEAFYKYIKNLLSKLEGADYFLDKIEREDFLR<br>KQRTFDNGSIPHQIHLQEMNAILRRQGEHYPFLKDNKEKIEKILTFRIPYYVGPLARGNRDFAWLTR<br>NSDQAIRPWNFEEVVDKASSAEDFINKMTNYDLYLPEEKVLPKHSLLYETFAVYNELTKVKPIAEG<br>LRDYQFLDSGQKKQIVNQLFKTKRKVTEKDIINYLHKVDGYDGVEISGVEDRFNASLGTYHDLLKI<br>IKDKSFLDDKKNEEIIEDIVLTLTLFEDRDMIRQRLQKYSDIFTPQQLKKLERRHYTGWGRLSYKLIN<br>GIRNKENNKSILDYLIDDGYANRNFMQLINDDTLPFKQIIQKSQVVGDIDDDIKTVVHDLPGSPAIKK<br>GILQSVKIVDELVKVMGHNPDNIVIEMARENQTTNRGRSQSQQRLKKLQESLKELGSNILNVEKPS<br>YIEDKVENNHLQNDKLFLYYIQNGKDMYTGEELDIDHLSDYDIDHIIPQAFIKDDSIDNRVLTSSAK<br>NRGKSDDVPSLDIVRGRKAEWIRLYKAKLISQRKFDNLTKAERGGLTENDKAGFIKRQLVETRQIT<br>KHVAQILDARFNTKRDENDKLIREVKVITLKSNLVSQFRKEFGFYKVREINDYHHAHDAYLNAVV<br>GTAILKKYPKLTSEFVYGEYKKYDIRKFIKSDDHSEMGKATAKYFFYSNLLNFFKEEIKYANGKIVV<br>RPVVEYSKDTGEIAWNKEKDFATVRKVLSCPQVNIVKKTEVQTGGFSKESILPKRNSDKLIPRKTE<br>WDPKKYGGFDSPTVAYSVLVVAKVEKGKSKKLKSVKELVGITIMERSSFEKDPVDFLEAKGYKEV<br>RKDLIIKLPKYSLFELENGRRRLLASAGELQKGNELALPSKYVNFLYLASHYEKLKGSPEDNEQKQ<br>LFVEQHKHYLDEIVEQISEFSERVILADANLDKVLSAYNKNRDRPIREQAENIIHLFTLTNLGAPAAF<br>KFFDTTIDRKRYTSTKEVLDATLIHQSITGLYETRIDLSQLGGD |
| 280 | MKKPYSIGLDIGTNSVGWAIVDDDYKVPAKKMRVFGDTDRSHIKKNLLGTLLFDSGETAESRRLK<br>RTARRRYTRRRNRILYLQEIFAEEMNKVDDSFFHRLEDSFLVEEDKQGSKYPIFGTLEEEKEYHKQF<br>PTIYHLRKQLAESNEKADLRLIYLALAHMIKYRGHFLIDDPKFKVQNNDIQGLFEKFVEEYDNVQE<br>TSLSKIKLNVTEILTANIPKSEKQEQLLKNYPSEKKNTLFGNLIGLALGLTPNFKTNFSLENDAKLQIS<br>SESYEEDLGNLLALIGENFIELFSAVKNLSDGILLAGIVSDESPHAPLSTKMVIRFKEHEEDLAALKH<br>FIKANLPEKYDEVFSDDSKNGYAGYVGVDSKVRKRNGKLATEEEFYKYLKDILNNVKGADYFLEK<br>IKREDFLRKQRTFDNGSIPYQVHLTEMKAILRQGEHYPFLKENKEKIEKILTFRIPYYVGPLARGNR<br>DFAWLTRNSDQAIRPWNFEEVVDKASSAEDFINKMTNYDLYLPEEKVLPKHSLLYETFAVYNELT |

| SEQ ID NO | Nuclease Sequence |
|---|---|
| | KVKFIAEGLRDYQFLDSGQKKQIVNQLFKEKRKVTEKDIIHYLHNVDGYDGIELKGIEKQFNASLST YHDLLKIIKDKEFMDDPKNEEILENIVHTLTIFEDREMIKQRLAQYDSIFDEKVIKALTRRHYTGWG KLSAKLINGICDKKTGKTILDYLIDDGKINRNFMQLINDDGLSFKEIIQKAQVVGKTDDVKQVVQEL PGSPAIKKGILQSIKIVDELVKVMGHAPESIVIEMARENQTTARGKKNSQQRYKRIEDALKNLAPGL DSNILKENPTDNIQLQNDRLFLYYLQNGKDMYTGEPLDINQLSSYDIDHIIPQAFIKDDSLDNRVLTS SKDNRGKSDNVPSIEVVQKRKAFWQQLLDSKLISERKENNLTKAERGGLDERDKVGFIKRQLVETR QITKHVAQILDARFNTEVDENNQKIREVKIITLKSNLVSNFRKEFGLYKVREINDYHHAHDAYLNA VVAKAILKKYPKLEPEFVYGDYQKYDIKRYISRSKDPKDIEKATEKYFFYSNLLNFFKEEVHYADG TIIKRENIEYSKDTGEIAWNKEKDFATVRKVLSCPQVNIVKKTEVQTGGFSKESILPKRNSDKLIARK KDWDPKKYGGFDSPTVAYSVLVVAKVEKGKSKKLKSVKELVGITIMERSSFEKDPVDFLEAKGYK EVRKDLIIKLPKYSLFELENGRKRMLASAGELQKGNELALPSKYVNFLYLASHYEKLKGSPEDNEQ KQLFVEQHKHYLDEIIEQISEFSKRVILADANLDKVLSAYNKHRDKPIREQAENIIHLFTLTNLGAPA AFKYFDTTIDRKRYTSTKEVLDATLIHQSITGLYETRIDLSQLGGD |
| 281 | MKKPYSIGLDIGTNSVGWAVVTDDYKVPAKKMKVLGNTDKSHIKKNLLGALLFDSGNTAEDRRL KRTARRRYTRRRNRILYLQEIFAEEMNKVDESFFHRLDDSFLVPEDKRGSKYPIFGTLEEEKEYHKQ FPTIYHLRKQLAESNEKADLRLVYLALAHMIKYRGHFLIDDPKFKVQNNDIQGLFEKFVEEYDNVQ ETSLSKIKLNVTEILTANIPKSEKQEQLLKNYPSEKKNTLFGNLIGLALGLTPNFKTNFSLENDAKLQI SSESYEEDLGSLLALIGENFIELFSAVKNLSDGILLAGIVSDESPHAPLSTKMVIRFKEHEEDLAALKH FIKANLPEKYDEVFSDDSKNGYAGYVGVDSKVRKRNGKLATEEEFYKYLKEILNNLKGADYFLEK IKREDLLRKQRTFDNGTIPYQVHLTEMKAIIHRQGEHYPFLKENKEKIEKILTFRIPYYVGPLARGNR DFAWLTRNSDQAIRPWNFEEVVDKASSAEDFINKMTNYDLYLPEEKVLPKHSLLYETFAVYNELT KVKFIAEGLRDYQFLDSGQKKQIVNQLFKEKRKVTEKDIIHYLHNVDGYDGIELKGIEKQFNASLST YHDLLKIIKDKEFMDDPKNEEILENIVHTLTIFEDREMIKQRLAQYDSLFDEKVIKALTRRHYTGWG KLSAKLINGICDKQTGKTILDYLIDDDKINRNFMQLINDDGLSFKEIIQKAQVVGKTDDVKQVVQEL PGSPAIKKGILQSIKIVDELVKVMGHAPESIVIEMARENQTTARGKKNSQQRYKRIEDALKNLAPGL DSNILKENPTDNIQLQNDRLFLYYLQNGKDMYTGEALDINQLSNYDIDHIIPQAFIKDDSLDNRVLT SSKDNRGKSDNVPSLEVVEKMKAFWQQLLDSKLISERKYNNLTKAERERGGLNELDKVGFIKRQL VETRQITKHVAQILDARFNTEVNENNQKIRKVKIITLKSNLVSNFRKEFGLYKVREINDYHHAHDA YLNAVVAKAILKKYPKLEPEFVYGDYQKYDIKRYISRSKDPKEIEKATEKYFFYSNLLNFFKEEVH YADGTIVKRENIEYSKDTGEIAWNKEKDFATVRKVLSCPQVNIVKKTEVQTGGFSKESILPKRNSD KLIPRKTEWDPKKYGGFDSPIVAYSVLVVAKVEKGKSKKLKPVKELVGITIMERSSFEKDPVDFLE AKGYKEVRKDLIIKLPKYSLFELENGRKRMLASAGELQKGNELALPSKYVNFLYLASHYEKLKGSP EDNEQKQLFVEQHKHYLDEIVEQISEFSERVILADANLDKILSAYNKHRDKPIREQAENIINLFTFTN LGAPAAFKFFDTDIDRKRYTSTKEVLDATLIHQSITGLYETRIDLSQLGGD |
| 282 | MNKPYSIGLDIGTNSVGWSVVDDDYKVPAKKMRVFGDTDKGHIKKNLLGTLLFDSGETAESRRLK RTARRRYTRRRNRILYLQEIFAKEMAKVDESFFHRLDESFLTDDDKTFDSHPIFGNKAEEDAYHQQ FPTIYHLRKHLADSTEKADLRLVYLALAHMIKFRGHFLIEGELNAENTDVQKLFADFVGVYDRTFD DSHLSEITVDASSILTEKISKSRRLEKLIKHYPTEKKNTLFGNLVALALGLQPNFKTNFKLSEDAKLQ FSKDTYEEDLEELLGKIGDDYADLFTSAKNLYDAILLSGILTVDDESTKAPLSASMIKRYAEHHEDL EKLKFVKANKPELYHDIFKDESKNGYAGYIENGVKQDEFYKYLKSTLSKQDGSQYFLDKIEREDF LRKQRTFDNGSIPHQLHLKEMRSILHRQGEYYPFLKENQAKIEKILTFRIPYYVGPLARKDSRFAWA EYHSDEPITPWNFDEVVDKEKSAEKFITRMTLNDLYLPEEKVLPKHSHVYETYTVYNELTKVKYV NEQGEAKFFDANMKQEIFDHVFKENRKVTKDKLMDFLGKEFDEFRIVDITGLDKENKAFNASLGT YHDLKKIIDKSFLDDKENETIIEDIIQTLTLFEDRDMIRQRLQKYSDIFTPQQLKKLERRHYTGWGRL SYKLINGIRDKQTGKTILDYLIDDGYANRNFMQLINDDTLPFKEIIQKAQIIGDIDDIKAVVHDLPGSP AIKKGILQSVKIVDELVKVMGHNPDNIVIEMARENQTTNRGRTQSQQRLKKLQESLKELGSNILNE KKPSYVEDKVENTHLQNDRLFLYYIQNGKDMYTGDELDIDHLSDYDIDHIIPQAFIKDDSIDNRVLT SSAKNRGKSDDVPSIEIVRDRKADWMRLRKAGLISKRKFDNLTKAERGGLTEADKAGFIKRQLVET RQITKHVAQILDSRENTERDENDKVIREVKVITLKSNLVSQFRKDFQFYKVREINDYHHAHDAYLN AVVGTALIKKYPKLESEFVYGDYKVYDVRKMIAKSEQEIGKATAKRFFYSNIMNFFKTEIKLANGE IRKRPLIETNEETGEIVWNKEKDFATVRKVLSCPQVNIVKKTEVQTGGFSKESILPKRNSDKLIPRKK DWDPKKYGGFDSPTVAYSVLVVAKVEKGKSKKLKPVKELVGITIMERSSFEKNPIDFLEAKGYKE VQKDLIIKLPKYSLFELENGRRRMLASAGELQKGNELALPSKYVNFLYLASHYEKLKGSPEDNEQK QLFVDQHKHYLDEIIEQISEFSERVILADANLDKVLSAYNKHRDKPVREQAENIIHLFTLTNLGAPA AFKFFDTTIDRKRYTSTKEILDATLIHQSITGLYETRIDLSQLGGD |
| 283 | MKKPYSIGLDIGTNSVGWAVVDDDYKVPAKKMRVFGDTDRSHIKKNLLGTLLFDDGNTAESRRL KRTARRRYTRRRNRILYLQEIFAEEMNKVDESFFHRLDDSFLVPEDKRGSKYPIFATLEEEKEYHKK FPTIYHLRKHLADSKEKTDLRLIYLALAHMIKYRGHFLYEESFDIKNNDIQKIFNEFISLYDNTFEGSS LSGQNAQVEAIFTDKISKSAKRERVLKLFPDEKSTGLFSEFLKLIVGNQADFKKHFDLEEKAPLQFS KDTYDEDLENLLGQIGDDFADLFLVAKKLYDAILLSGILTVTDPSTKAPLSASMIERYENHEEDLAA LKQFVKANLPEKYDEVFSDQKDGYAGYIDGKTTQEAFYKYIKNLLSKLEGADYFLDKIEREDFLR KQRTFDNGSIPHQIHLQEMNAILRRQGEHYPFLKDNKEKIEKILTFRIPYYVGPLARGNRDFAWLTR NSDQAIRPWNFEEVVDKASSAEDFINKMTNYDLYLPEEKVLPKHSLLYETFAVYNELTKVKFIAEG LRDYQFLDSGQKKQIVNQLFKTKRKVTEKDIINYLHKVDGYDGVEISGVEDRFNASLGTYHDLLKI IKDKSFLDDKNEEIIEDIVLTLTLFEDRDMIRQRLQKYSDIFTPQQLKKLERRHYTGWGRLSYKLIN GIRNKENNKSILDYLIDDGYANRNFMQLINDDTLPFKQIIQKSQVGDIDDIKTVVHDLPGSPAIKK GILQSVKIVDELVKVMGHNPDNIVIEMARENQTTNRGRSQSQQRLKKLQESLKELGSNILNVEKPS YIEDKVENNHLQNDKLFLYYIQNGKDMYTGEELDIDHLSDYDIDHIIPQAFIKDDSIDNRVLTSSAK NRGKSDDVPSLDIVRGRKAEWIRLYKAKLISQRKFDNLTKAERGGLTENDKAGFIKRQLVETRQIT KHVAQILDARFNTKRDENDKLIREVKVITLKSNLVSQFRKEFGFYKVREINDYHHAHDAYLNAVV GTAILKKYPKLTSEFVYGEYKKYDIRKFIKSDDHSEMGKATAKYFFYSNLLNFFKEEIKYANGKIVV |

-continued

| SEQ ID NO | Nuclease Sequence |
|---|---|
|  | RPVVEYSKDTGEIAWNKEKDFATVRKVLSCPQVNIVKKTEVQTGGFSKESILPKRNSDKLIARKKD WDPKKYGGFDSPTVAYSVLVVAKVEKGKSKKLKSVKELVGITIMERSSFEKDPVDFLEAKGYKEV RKDLIIKLPKYSLFELENGRKRMLASAGELQKGNELALPSKYVNFLYLASHYEKLKGSPEDNEQKQ LFVEQHKHYLDEIIEQISEFSKRVILADANLDKVLSAYNKHRDKPIREQAENIIHLFTLTNLGAPAAF KYFDTTIDRKRYTSTKEVLDATLIHQSITGLYETRIDLSQLGGD |
| 284 | MTKPYSIGLDIGTNSVGWAVITDSYKVPSKKMKVLGNTSKKYVKKNLLGALLFESGITAEGRRLK RTARRYTRRRNRILYLQEIFSTEMAKIDESFFQRLDDSFLVPDDKRDSKYPIFGNLVKEKTYHDEF PTIYHLRKYLADSSKKADLRLVYLALAHMIKYRGHFLIEGDFNSRNNDIKKNFQNFLDSYNAIFESD LSLENSKQLEEIVKDKISKSAKKERVLKLFPDEKSTGLFSEFLKLIVGNQADFKKHFDLEEKAPLQFS KDTYDEDLENLLGQIGDDFADLFLVAKKLYDAILLSGILTVTDPSTKAPLSASMIERYENHQKDLSA LKQFIRSNLSEKYDEVFSDQSKDGYAGYINGKTTQEAFYKYIKNLLSKFEGADYFLDKIEREDFLRK QRTFDNGSIPHQIHLQEMNAIIRRQGEHYPFLKENKEKIEKILTFRIPYYVGPLARGNRDFAWLTRNS DQAIRPWNFEEVVDKASSAEAFINKMTNFDLYLPEEKVLPKHSLLYETFAVYNELTKVKFIAEGLR DYQFLDSGQKKQIVNQLFKEKRKVTEKDIIQFLHNVDGYDGIELKGIEKQFNASLATYHDLLKIIKD KEFMDDPKNEEILENIIHTLTIFEDREMIKQRLAQYDSLFDEKVIKALTRRHYTGWGKLSAKLINGIC DKQTGKTILDYLIDDGFSNRNFMQLINDDTLPFKQIIQKAQIVGDVDDIEQVVHDLPGSPAIKKGILQ SIKIVDELVKVMGHNPDNIVIEMARENQTTNRGRSQSQQRLKKLQDSLKELGSNILNEEKPSYIESK VENSQLQNDRLFLYYIQNGKDMYTGDELDIDRLSDYDIDHIIPQAFIKDDSIDNRVLTSSAKNRGKS DDVPSLEVVRKRKTYWHQLLKSKLISQRKFDNLTKAERGGLTEKDKAGFIKRQLVETRQITKHVA QILDSRFNTKRDENDKVIRDVKVITLKSNLVSQFRKDFGFYKVREINDYHHAHDAYLNAVVGTAL LKKYPKLAPEFVYGEYKKYDVRKIVRSKDESSLGKATAKMFFYSNLMNFFKKEVRLSDGTVIVRP VIEYSKDTGEIAWNKEKDFATVRKVLSCPQVNIVKKTEVQTGGFSKESILPKRNSDKLIPRKKDWD PKKYGGFDSPTVAYSVLVVAKVEKGKSKKLKSVKELVGITIMERSSFEKDPVDFLEAKGYKEVRK DLIIKLPKYSLFELENGRKRMLASAGELQKGNELALPSKYVNFLYLASHYEKLKGSPEDNEQKQLF VEQHKHYLDEIIEQISEFSERVILADANLDKVLSAYNNHRDKPIREQAENIIHLFTLTNLGAPAAFKF FDTTIDRKRYTSTKEVLDATLIHQSITGLYETRIDLSKLGGD |
| 285 | MKKSYSIGLDIGTNSVGWAVVDDDYKVPAKKMRVFGDTDRSHIKKNLLGTLLFDEGNTAESRRL KRTARRYTRRRNRILYLQEIFATEMNKVDESFFHRLDDSFLVPEDKRGSKYPIFATLEEEKEYHKQ FPTIYHLRKQLAESNEKADLRLVYLALAHMIKYRGHFLIDDPKFKVQNNDIQGLFEKFVEEYDNVQ ETSLSKIKLNVTEILTANIPKSEKQEQLLKNYPSEKKNTLFGNLIGLALGLTPNFKTNFSLENDAKLQI SSESYEEDLGNLLALIGENFIELFSAVKNLSDGILLAGIVSDGSHAPLSAKMVIRFKEHEEDLAALK HFIKANLPEKYDEVFSDDSKNGYAGYVGVDSKVRKRNGKLATEEEFYKYLKEILNNVKGADYFLE KIKREDFLRKQRTFDNGTIPYQVHLTEMRAILHRQGEYYPFLKENKEKIEKILTFRIPYYVGPLARG NRDFAWLTRNSDQAIRPWNFEEVVDKASSAEDFINKMTNYDLYLPEEKVLPKHSLLYETFAVYNE LTKVKFIAEGLRDYQFLDSGQKKQIVNQLFKEKRKVTEKDIIHYLHNVDGYDGIELKGIEKQFNASL STYHDLLKIIKDKEFMDDPKNEEILENIVHTLTIFEDREMIKQRLAQYDSLFDEKVIKALTRRHYTG WGKLSAKLINGIYDKQSKKTILDYLIDDDKINRNFMQLINDDGLSFKEIIQKAQVVGKTDDVKQVV QELPGSPAIKKGILQSIKIVDELVKVMGHAPESIVIEMARENQTTARGKKNSQQRYKRIEDALKNLA PGLDSNILKENPTDNIQLQNDRLFLYYLQNGKDMYTGEELDINQLSNYDIDHIVPQAFIKDDSLDNR VLTSSKDNRGKSDNVPSLEVVQKRKAFWQQLLDSKLISERKENNLTKAERGGLDERDKVGFIRRQ LVETRQITKHVAQILDARFNTEVTENNQKIRKVKIITLKSNLVSNFRKEFGLYKVREINDYHHAHDA YLNAVVAKAILKKYPKLEPEFVYGDYQKYDIKRYISRSKDPKEVEKATEKYFFYSNLLNFFKEEVH YADGTIVKRENIEYSKDTGEIAWNKEKDFATVRKVLSCPQVNIVKKTEVQTGGFSKESILPKRNSD KLIPRKTEWDPKKYGGFDSPIVAYSVLVVAKVEKGKSKKLKPVKELVGITIMERSSFEKDPVELA AKGYKEVRKDLIIKLPKYSLFELENGRKRMLASAGELQKGNELALPSKYVNFLYLASHYEKLKGSP EDNEQKQLFVEQHKHYLDEIVEQISEFSERVILADANLDKILSAYNKHRDKPIREQAENIINLFTFTN LGAPAAFKFFDTDIDRKRYTSTKEVLDATLIHQSITGLYETRIDLSQLGGD |
| 286 | MDKKYSIGLDIGTNSVGWAVITDDYKVPAKKMKVLGNTDKRTIKKNLLGALLFDSGETAEATRLK RTARRYTRRKNRLRYLQEIFSKEMSNVDANFFYRLEDSFLVPEDKQQERHPIFGNLVEEIEYHKEF PTIYHLRKQLADSKEKADLRLIYLALAHMIKYRGHELFEGDLKSENTDVQRLFKDFVEVYDKTVEG SYLSENLTNVTDVLVEKISKSRRLENILHYFPNEKKNGLFGNLPLALALGLQPNFKNNFDLAEEAKL QISKDTYEEELEVLLAQIGDNYAELFIATKELYDGILLAGILTVTDSSTKAPLSASMIERYENHQGDL AKLKAFIRRFCKETYDEVFSDEVKDGYAGYIEGKTSQEDFYVHLKKLLANLEGADYFLEKINREDL LRKQRTFDNGSIPYQIHLVEMRAILDKQAKFYPFLAKNQDRIEKLLTFRIPYYVGPLARGKSDFAWL SRKSADKITPWNFDEIVDKESSSAEAFINRMTNYDLYLPNQKVLPKHSLLYEKFTVYNELTKVKYKT EQGKTAFFDANMKQEIFDGVFKVYRKVTKDKLMDFLEKEFDEFRIVDLMGLDKENKAFNASYGT YHDLRKILDKDFLDNSDNEKILEDIVLTLTLFEDREMIRKRLEKYKDIFTEKQRKQLERRHYTGWG RLSAKLIHGIRNKESRKTILDYLIDDGYSNRNFMQLINDDTLTFKEEIAKAQVVGETDSLKQFISELA GSPAIKKGILQTVKIVDELVKVMGHKPENIVIEMARENQTTQKGQKNSQERMKRIEEGIKELGSQIL KEHPVENTQLQNEKLYLYYLQNGRDMYVDQELDINRLSDYDIDHIIPQAFIKDDSIDNRVLTSSKD NRGKSDNVPSEDVVKKMKNYWRQLLNAKLISQRKFDNLTKAERGGLSELDKVGFIKRQLVETRQI TKHVAQILDSRMNTKYDENDKLIRDVKIITLKSLVSDFRKDFQYKVREINNYHHAHDAYLNAV VGTALIKKYPKLESEFVYGDYKVYDVQKMIAKSEQEIGKATAKFFFYSNIMNFFKTEITLANGEIRK RPMIETNEETGEIVWDKGRDFATVRKVLCMPQVNIVKKTEVQTGGFSKESILPKRNSDKLIPRKKG WDPKKYGGFDSPTVAYSVLVVAKVEKGKSKKLKMKYGGITIMERSSFEKDPVDFLEAKGYKEV RKDLIIKLPKYSLFELENGRKRMLASAGELQKGNELALPSKYVNFLYLASHYEKLKGSPEDNEQKQ LFVEQHKHYLDEIVEQISEFSERVILADANLDKVLSAYNKNRDRPIREQAENIIHLFTLTNLGAPAAF KFFNTDIDRKRYTSTKEILDATLIHQSITGLYETRIDLSQLGGD |
| 287 | MKKPYSIGLDIGTNSVGWAVVTDDYKVPAKKMKVLGNTNKESIKKNLIGALLFDAGNTAADRRL KRTARRYTRRRNRILYLQEIFAEEMNKVDESFFHRLDDSFLVPEDKRGSKYPIFATLEEEKEYHKK |

-continued

Sequences

| SEQ ID NO | Nuclease Sequence |
|---|---|
|  | FPTIYHLRKHLADSKEKADLRLIYLALAHMIKYRGHFLYEESFDIKNNDIQKIFNEFISIYDNTFEGSS<br>LSGQNAQVEAIFTDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIQNNLQEKYDEVFSDQSKDGYAGYIDGKTTQEAFYKYIKNLLSKLEGADYFLDKIEREDFL<br>RKQRTFDNGSIPHQIHLQEMNAIIRRQGEHYPFLKENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEG<br>MRDYQFLDSGQKKKIVSQLFEDKRKVTEKDIIHYLHTIDGYDGIELSGIEKQFNASLSTYHDLLKIIK<br>DKAFLDDSENEAIIEEIIHTLTIFEDREMIKQRLAQYADIFDKSVLKKLARRHYTGWGKLSAKLINGI<br>RDKQSNKTILDYLIDDGKINRNFMQLINDDSLSFKETIQKAQVVGDTDDVKQVVQELPGSPAIKKGI<br>LQSIKIVDELVKVMGHNPDNIVIEMARENQTTNRGRSQSQQRLKKLQDSLKELGSNILNEEKPSYIE<br>DKVENSHLQNDQLFLYYIQNGKDMYTGEELDIDHLSDYDIDHIIPQAFIKDDSIDNRVLTSSAKNRG<br>KSDDVPSLDIVRERKADWIRLYKSKLISKRKFDNLTKAERGGLTEADKAGFIKRQLVETRQITKHV<br>AQILDSRFNTKRDENDKVIRDVKVITLKSNLVSQFRKDFELYKVREINDYHHAHDAYLNAVVGTA<br>LLKKYPKLAPEFVYGEYKKYDIRKFITSSKDKATAKYFFYSNLMNFFKRIIRYSNGKIVVRPVVEYS<br>KDTGEIAWNKEKDFATVRKVLSCPQVNIVKKTEVQTGGFSKESILPKRNSDKLIARKKDWDPKKY<br>GGFDSPTVAYSVLVVAKVEKGKSKKLKSVKELVGITIMERSSFEKDPVDFLEAKGYKEVRKDLIIK<br>LPKYSLFELENGRKRMLASAGELQKGNELALPSKYVNFLYLASHYEKLKGSPEDNEQKQLFVEQH<br>KHYLDEIIEQISEFSKRVILADANLDKVLSAYNKHRDKPIREQAENIIHLFTLTNLGAPAAFKYFDTTI<br>DRKRYTSTKEVLDATLIHQSITGLYETRIDLSQLGGD |
| 288 | MKKSYSIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHIIKFRGHFLIEGQLNAENTDVQTLFNDFVEVYDKTVEE<br>SHLSEITVDALSILTEKVSKSRRLENLVKCYPTEKKNTLFGNLIALSLGLQPNFKTNFKLSEDAKLQF<br>SKDTYEEDLEELLGKIGDEYADLFASAKNLYDAILLSGILTADDNSTKAPLSASMVKRYAEHHEDL<br>EKLKEFVKANKPELYHDIFKDETKNGYAGYIENGVKQDEFYKYLKNTLSKIAGSDYFLDKIEREDF<br>LRKQRTFDNGSIPHQIHLQEMHAILRRQGEYYPFLKENQAKIEKILTFRIPYYVGPLARKNSRFAWA<br>EYHSDEKITPWNFEEIVDKEESATAFIHRMTNNDLYLPEEKVLPKHSLIYEEFTVYNELTKVRYTD<br>QGKAYYFDANMKQEIFDGVFKEHRKVTKDKLMNFLEKEFDEFRIVDLTGLDKENKSFNASLGTYH<br>DLKKILDKSFLDDKTNETIIEDIIQTLTLFEDRDMIRQRLQKYSDIFTPQQLKKLERRHYTGWGRLSY<br>KLINGIRNKENGKTILDYLIDDGYANRNFMQLINDDTLPFKQIIQEAQIIGDIDDIETVVHDLPGSPAI<br>KKGILQSVKIVDELVKVMGHNPDNIVIEMARENQTTNRGRSQSQQRLKKLQESLKELGSNILNEEK<br>PSYVEDKVENSHLQNDKLFLYYIQNGKDMYTGEELDIDHLSDYDIDHIIPQAFIKDNSIDNRVLTSS<br>AKNRGKSDDVPSLDIVHDRKADWIRLYKSGLISKRKFDNLTKAEHGGLTEDDKAGFIKRQLVETR<br>QITKHVAQILDSRENTERDENDKVIRDVKVITLKSNLVSQFRKDFELHKVREINDYHHAHDAYLNA<br>VIGNALLVKYPQLEPEFVYGKFSHFHGHKENKATAKKFFYSNIMALFKKDVEYSDDTGEMVWNK<br>EKDFATVRKVLSCPQVNIVKKTEVQTGGFSKESILPKRNSDKLIPRKKDWDPKKYGGFDSPIVAYS<br>VLVVAKVEKGKSKKLKPVKELVGITIMERNSFEKDPIDFLEAKGYKEVRKDLIIKLPKYSLFELENG<br>RKRMLASAGELQKGNELALPSKYVNFLYLASHYEKLKGSPEDNEQKQLFVEQHKHYLDEIIEQISE<br>FSERVILADANLDKVLSAYNNHRDKPIREQAENIIHLFTLTNLGAPAAFKFFDTTIDRKRYTSTKEVL<br>DATLIHQSITGLYETRIDLSQLGGD |
| 289 | MKKSYSIGLDIGTNSVGWSVITDDYKVPAKKMKVLGNTDKKYIKKNLLGALLFDSGETAEATRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHMIKFRGHFLIEGQLNAENTDVQTLFNDFVEVYDKTVE<br>ESHLSEITVDALSILTEKVSKSRRLENLVKCYPTEKKNTLFGNLIALSLGLQPNFKTNFKLSEDAKLQ<br>FSKDTYEEDLEELLGKIGDEYADLFASAKNLYDAILLSGILTVDDNTTKAPLSASMVKRYAEHHED<br>LEKLKEFVKANKPELYHDIFKDETKNGYAGYIENGVKQDEFYKYLKNTLSKIAGSDYFLDKIERED<br>FLRKQRTFDNGSIPHQIHLQEMHAILRRQGEYYPFLKENQAKIEKILTFRIPYYVGPLARKNSRFAW<br>AEYHSDEKITPWNFEEIVDKEESATAFIHRMTNNDLYLPEKHSLIYEEFTVYNELTKVKYVT<br>DQGKAYYFDANMKQEIFDGVFKEHRKVTKDKLMNFLEKEFDEFRIVDLTGLDKENKSFNASLGTY<br>HDLKKILDKSFLDDKTNETIIEDIIQTLTLFEDRDMIRQRLQKYSDIFTPQQLKKLERRHYTGWGRLS<br>YKLINGIRNKENGKTILDYLIDDGYANRNFMQLINDDTLPFKQIIQEAQIIGDIDDIETVVHDLPGSPA<br>IKKGILQSVKIVDELVKVMGHNPDNIVIEMARENQTTNRGRSQSQQRLKKLQESLKELGSNILNEEK<br>PSYVEDKVENSHLQNDKLFLYYIQNGKDMYTGEELDIDHLSDYDIDHIIPQAFIKDNSIDNRVLTSS<br>AKNRGKSDDVPSLDIVHDRKADWIRLYKSGLISKRKFDNLTKAEHGGLTEDDKAGFIKRQLVETR<br>QITKHVAQILDSRENTERDENDKVIRDVKVITLKSNLVSQFRKDFELHKVREINDYHHAHDAYLNA<br>VIGNALLVKYPQLEPEFVYGKFKHFHGHKENKATAKKFFYSNIMALFKKDVEYSDDTGEMVWNK<br>EKDFATVRKVLSCPQVNIVKKTEVQTGGFSKESILPKRNSDKLIARKKDWDPKKYGGFDSPTVAYS<br>VLVVAKVEKGKSKKLKSVKELVGITIMERSSFEKDPIDFLEAKGYKEVRKDLIIKLPKYSLFELENG<br>RKRMLASAGELQKGNELALPSKYVNFLYLASHYEKLKGSPEDNEQKQLFVEQHQHYLDEIIEQISE<br>FSKRVILADANLDKVLSAYNKHRDKPIREQAENIIHLFTLTNLGAPAAFKYFDTTIDRKRYTSTKEV<br>LDATLIHQSITGLYETRIDLSQLGGD |
| 290 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKKERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC |

| SEQ ID NO | Nuclease Sequence |
|---|---|
| | DKQTGKTILDYLIDDGFSNRNFMQLINDDTLPFKQIIQKAQIVGDVDDIEQVVHDLPGSPAIKKGILQ<br>SIKIVDELVKVMGHNPDNIVIEMARENQTTNRGRSQSQQRLKKLQDSLKELGSNILNEEKPSYVESK<br>VENSQLQNDRLFLYYIQNGKDMYTGEELDIDRLSDYDIDHIIPQAFIKDDSIDNRVLTSSAKNRGKS<br>DDVPSLEVVRKRKTYWHQLLKSKLISQRKFDNLTKAERGGLTEKDKAGFIKRQLVETRQITKHVA<br>QILDSRFNTKRDENDKVIRDVKVITLKSNLVSQFRKDFGFYKVREINDYHHAHDAYLNAVVGTAL<br>LKKYPKLAPEFVYGEYKKYDVRKLVRSKDESSLGKATAKMFFYSNLMNFFKKEVRLSDGTVIVRP<br>VIEYSKDTGEIAWNKEKDFATVRKVLSCPQVNIVKKTEVQTGGFSKESILPKRNSDKLIPRKKDWD<br>PKKYGGFDSPTVAYSVLVVAKVEKGKSKKLKPVKELVGITIMERSSFEKDPVDFLEAKGYKEVRK<br>DLIIKLPKYSLFELENGRKRMLASAGELQKGNELALPSKYVNFLYLASHYEKLKGSPEDNEQKQLF<br>VEQHKHYLDEIVEQISEFSERVILADANLDKVLSAYNNHRDKPIREQAENIIHLFTLTNLGAPAAFKF<br>FDTTIDRKRYTSTKEVLDATLIHQSITGLYETRIDLSKLGGD |
| 291 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTATDPSTKAPLSASMIERYENHQKDLST<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKIIKALTRRHYTGWGKLSAKLINGIC<br>DKQTGKTILDYLIDDGFSNRNFMQLINDDTLPFKQIIQKAQIVGDVDDIEQVVHNLPGSPAIKKGILQ<br>SIKIVDELVKVMGHNPDNIVIEMARENQTTNRGRSQSQQRLKKLQESLKELGSNILNEEKPSYVESK<br>VENSQLQNDRLFLYYIQNGKDMYTGEELDIDRLSDYDIDHIIPQAFIKDDSIDNRVLTSSAKNRGKS<br>DDVPSLEVVKKRKTYWHQLLKSKLISQRKFDNLTKAERGGLTEKDKAGFIKRQLVETRQITKHVA<br>QILDSRFNTKRDENDKVIRDVKVITLKSNLVSQFRKEFGFYKVREINDYHHAHDAYLNAVVGTALL<br>KKYPKLAPEFVYGEYKKYDVRKIVRSKDESSLGKATAKMFFYSNLMNFFKKEVRLSDGTVIVRPVI<br>EYSKDTGEIAWNKEKDFATVRKVLSCPQVNIVKKTEVQTGGFSKESILPKRNSDKLIPRKKDWDPK<br>KYGGFDSPTVAYSVLVVAKVEKGKSKKLKPVKELVGITIMERSSFEKDPIDFLEAKGYKEVRKDLII<br>KLPKYSLFELENGRKRLLASAGELQKGNELALPSKYVNFLYLASHYEKLKGSPEDNEQKQLFVEQ<br>HKHYLDEIVEQISEFSERVILADANLDKVLSAYNKHRDKPIREQAENIIHLFTLTNLGAPAAFKFFDT<br>TIDRKRYTSTKEVLDATLIHQSITGLYETRIDLSKLGGD |
| 292 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKEKTYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC<br>DKQTGKTILDYLIDDGFANRNFMQLINDDTLPFKQIIQKAQIVGDVDDIEQVVHNLPGSPAIKKGIL<br>QSIKIVDELVKVMGHNPDNIVIEMARENQTTNRGRSQSQQRLKKLQESLKELGSNILNEEKPSYVES<br>KVENSQLQNDRLFLYYIQNGKDMYTGEELDIDRLSDYDIDHIIPQAFIKDDSIDNRVLTSSAKNRGK<br>SDDVPSLEVVKKRKTYWHQLLKAKLISQRKFDNLTKAERGGLTEKDKAGFIKRQLVETRQITKHV<br>AQILDSRFNTKRDENDKVIRDVKVITLKSNLVSQFRKDFGFYKVREINDYHHAHDAYLNAVVGTA<br>LLKKYPKLAPEFVYGEYKKYDVRKIVRSKDESSLGKATAKMFFYSNLMNFFKKEVRLSDGTVIVR<br>PVIEYSKDTGEIAWNKEKDFATVRKVLSCPQVNIVKKTEVQTGGFSKESILPKRNSDKLIARKKDW<br>DPKKYGGFDSPTVAYSVLVVAKVEKGKSKKLKSVKELLGITIMERSSFEKNPIDFLEAKGYKEVRK<br>DLIIKLPKYSLFELENGRKRMLASAGELQKGNELALPSKYVNFLYLASHYEKLKGSPEDNEQKQLF<br>VEQHKHYLDEIIEQISEFSKRVILADANLDKVLSAYNKHRDKPIREQAENIIHLFTLTNLGAPAAFKY<br>FDTTIDRKRYTSTKEVLDSTLIHQSITGLYETRIDLSQLGGD |
| 293 | MKKSYSIGLDIGTNSVGWAVVDDDYKVPAKKMRVFGDTDRSHIKKNLLGTLLFDEGNTAESRRL<br>KRTARRRYTRRRNRILYLQEIFATEMNKVDESFFHRLDDSFLVPDDKRGSKYPIFATLEEEEKYHKQ<br>FPTIYHLRKQLAESNEKADLRLVYLALAHMIKYRGHFLIDDPKFKVQNNDIQGLFEKFVEEYDNVQ<br>ETSLSKIKLNVTEILTANIPKSEKQEQLLKNYPSEKKNTLFGNLIGLALGLTPNFKTNFSLENDAKLQI<br>SSESYEEDLGNLLALIGENFIELFSAVKNLSDGILLAGIVSDESPHAPLSAKMVIRFKEHEEDLAALK<br>HFIKANLPEKYDEVFSDDSKNGYAGYVGVDSKVRKRNGKLATEEEFYKYLKEILNNVKGADYFLE<br>KIKREDFLRKQRTFDNGTIPYQVHLTEMRAILHRQGEYYPFLKENKEKIEKILTFRIPYYVGPLARG<br>NRDFAWLTRNSDQAIRPWNFEEVVDKASSAEDFINKMTNYDLYLPEEKVLPKHSLLYETFAVYNE<br>LTKVKFIAEGLRDYQFLDSGQKKQIVNQLFKEKRKVTEKDIIHYLHNVDGYDGIELKGIEKQFNASL<br>STYHDLLKIIKDKEFMDDPKNEEILENIVHTLTIFEDREMIKQRLAQYDSLFDEKVIKALTRRHYTG<br>WGKLSAKLINGIYDKQSKKTILDYLIDDDKINRNFMQLINDDGLSFKEIIQKAQVVGKTDDVKQVV<br>QELPGSPAIKKGILQSIKIVDELVKVMGHAPESIKRIEMARENQTTARGKKNSQQRYKRIEDALKNLA<br>PGLDSNILKENPTDNIQLQNDRLFLYYLSKHKGKDMYTGEELDLSNYDIDHIVPQAFIKDDSLDNR<br>VLTSSKDNRGKSDNVPSLEVVQKRKAFWQQLLDSKLISERKENNLTKAERGGLDERDKVGFIRRQ<br>LVETRQITKHVAQILDARFNTEVTENNQKIRKVKIITLKSNLVSNFRKEFGLYKVREINDYHHAHDA<br>YLNAVVAKAILKKYPLEPEFVYGDYQKYDIKRYISRSKDPKEVEKATEKYFFYSNLLNFFKEEVH<br>YADGTIVKRENIEYSKDTGEIAWNKEKDFATVRKVLSCPQVNIVKKTEVQTGGFSKESILPKRNSD<br>KLIPRKTEWDPKKYGGFDSPTVAYSVLVVAKVEKGKSKKLKSVKELVGITIMERSSFEKDPVDFLE |

| SEQ ID NO | Nuclease Sequence |
|---|---|
| | AKGYKEVRKDLIIKLPKYSLFELENGRRRLLASAGELQKGNELALPSKYVNFLYLASHYEKLKGSP<br>EDNEQKQLFVEQHKHYLDEIVEQISEFSERVILADANLDKVLSAYNKNRDRPIREQAENIIHLFTLTN<br>LGAPAAFKFFDTTIDRKRYTSTKEVLDATLIHQSITGLYETRIDLSQLGGD |
| 294 | MKKPYSIGLDIGTNSVGWAVVTDDYKVPAKKMKVLGNTNKESIKKNLIGALLFDAGNTAADRRL<br>KRTARRRYTRRRNRILYLQEIFAEEMNKVDESFFHRLDDSFLVPEDKRGSKYPIFATLEEEKEYHKK<br>FPTIYHLRKHLADSKEKADLRLIYLALAHMIKYRGHFLYEESFDIKNNDIQKIFNEFISIYDNTFEGSS<br>LSGQNAQVEAIFTDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHQKDLA<br>ALKQFIQNNLQEKYDEVFSDQSKDGYAGYIDGKTTQEAFYKYIKNLLSKLEGADYFLDKIEREDFL<br>RKQRTFDNGSIPHQIHLQEMNAIIRRQGEHYPFLKENKEKIEKILTFRIPYYVGPLARGNRDFAWLTR<br>NSDQAIRPWNFEEIVDQASSAEDFINKMTNYDLYLPEEKVLPKHSLLYETFAVYNELTKVKFIAEG<br>MRDYQFLDSGQKKKIVSQLFEDKRKVTEKDIIHYLHTIDGYDGIELSGIEKQFNASLSTYHDLLKIIK<br>DKAFLDDSENEAIIEEIIHTLTIFEDREMIKQRLAQYADIFDKSVLKKLARRHYTGWGKLSAKLINGI<br>RDKQSNKTILDYLIDDGKINRNFMQLINDDSLSFKETIQKAQVVGDTDDVKQVVQELPGSPAIKKGI<br>LQSIKIVDELVKVMGHNPDNIVIEMARENQTTNRGRSQSQQRLKKLQDSLKELGSNILNEEKPSYIE<br>DKVENSHLQNDQLFLYYIQNGKDMYTGEELDIDHLSDYDIDHIIPQAFIKDDSIDNRVLTSSAKNRG<br>KSDDVPSLDIVRERKADWIRLYKSKLISKRKFDNLTKAERGGLTEADKAGFIKRQLVETRQITKHV<br>AQILDSRFNTKRDENDKVIRDVKVITLKSNLVSQFRKDFELYKVREINDYHHAHDAYLNAVVGTA<br>LLKKYPKLAPEFVYGEYKKYDIRKFITSSKDKATAKYFFYSNLMNFFKRIIRYSNGKIVVRPVVEYS<br>KDTGEIAWNKEKDFATVRKVLSCPQVNIVKKTEVQTGGFSKESILPKRNSDKLIARKKDWDPKKY<br>GGFDSPTVAYSVLVVAKVEKGKSKKLKSVKELVGITIMERSSFEKDPIDFLEAKGYKEVRKDLIIKL<br>PKYSLFELENGRKRMLASAGELQKGNELALPSKYVNFLYLASHYEKLKGSPEDNEQKQLFVEQHK<br>HYLDEIIEQISEFSKRVILADANLDKVLSAYNKHRDKPIREQAENIIHLFTLTNLGAPAAFKYFDTTID<br>RKRYTSTKEVLDATLIHQSITGLYETRIDLSQLGGD |
| 295 | MKKSYSIGLDIGTNSVGWSVITDDYKVPAKKMKVLGNTDKKYIKKNLLGALLFDSGETAEGTRLK<br>RTARRRYTRRKNRLRYLQEIFAKEMAKVDESFFQRLEESFLTDDDKNFDSHPIFGNKAEEDAYHDE<br>FPTIYHLRQYLADSPQKADLRLVYLALAHMIKFRGHFLIQGLNAENTDVQTLFNDFVEVYDKTVE<br>ESHLSEITVDALSILTEKVSKSRRLENLVKCYPTEKKNTLFGNLIALSLGLQPNFKTNFKLSEDAKLQ<br>FSKDTYEEDLEELLGKIGDEYADLFASAKNLYDAILLSGILTVDDNSTKAPLSASMVKRYAEHHED<br>LEKLKEFVKANKPELYHDIFKDETKNGYAGYIENGVKQDEFYKLKNTLSKIAGSDYFLDKIERED<br>FLRKQRTFDNGSIPHQIHLQEMHAILRRQGEYYPFLKENQAKIEKILTFRIPYYVGPLARKNSRFAW<br>AEYHSDEKITPWNFEEIIDKEESATAFIHRMTNNDLYLPEEKVLPKHSLIYEEFTVYNELTKVRYVT<br>DQGKAYYFDANMKQEIFDGVFKEHRKVTKDKLMNFLEKEFDEFRIVDLTGLDKENKSFNASLGTY<br>HDLKKILDKSFLDDKTNETIIEDIIQTLTLFEDRDMIRQRLQKYSDIFTPQQLKKLERRHYTGWGRLS<br>YKLINGIRNKENGKTILDYLIDDGYANRNFMQLINDDTLPFKQIIQEAQIIGDIDDIETVVHDLPGSPA<br>IKKGILQSVKIVDELVKVMGHNPDNIVIEMARENQTTNRGRSQSQQRLKKLQESLKELGSNILNEEK<br>PSYIEDKVENSHLQNDRLFLYYIQNGKDMYTGEELDIDHLSDYDIDHIIPQAFIKDNSIDNRVLTSSA<br>KNRGKSDDVPSLDIVHDRKADWIRLYKSGLISKRKFDNLTKAEHGGLTEDDKAGFIKRQLVETRQI<br>TKHVAQILDSRENTERDENDKVIRDVKVITLKSNLVSQFRKDFELHKVREINDYHHAHDAYLNAVI<br>GNALLVKYPQLEPEFVYGKFSHFHGHKENKATAKKFFYSNIMALFKKDVEYSDDTGEMVWNKEK<br>DFATVRKVLSCPQVNVVKKTEVQTGGFSKESILPKRNSDKLIPRKNDWDPKKYGGFDSPIVAYSVL<br>VIAKVEKGKSKKLKPVKELVGITIMERSSFEKDPIDFLEAKGYKDVRKDLIIKLPKYSLFELENGRKR<br>MLASAGELQKGNELALPSKYVNFLYLASHYEKLKGSPEDNEQKQLFVEQHKHYLDEIIEQISEFSER<br>VILADSNLDKVLSAYNNHRDKPIREQAENIIHLFTLTNLGAPAAFKFFDTTIDRKRYTSTKEILDATLI<br>HQSITGLYETRIDLSQLGGD |
| 296 | MTKPYSIGLDIGTNSVGWAVITDSYKVPSKKMKVLGNTSKKYVKKNLLGALLFESGITAEGRRLK<br>RTARRRYTRRRNRILYLQEIFSTEMAKIDESFFQRLDDSFLVPDDKRDSKYPIFGNLVKETYHDEF<br>PTIYHLRKYLADSSKKADLRLVYLALAHMIKYRGHFLIEGDFNSRNNDIKKNFQNFLDSYNAIFESD<br>LSLENSKQLEEIVKDKISKSAKKERVLKLFPDEKSTGLFSEFLKLIVGNQADFKKHPDLEEKAPLQFS<br>KDTYDEDLENLLGQIGDDFADLFLVAKKLYDAILLSGILTVTDPSTKAPLSASMIERYENHQKDLSA<br>LKQFIRSNLSEKYDEVFSDQSKDGYAGYINGKTTQEAFYKYIKNLLSKFEGADYFLDKIEREDFLRK<br>QRTFDNGSIPHQIHLQEMNAIIRRQGEHYPFLKENKEKIEKILTFRIPYYVGPLARGNRDFAWLTRNS<br>DQAIRPWNFEEVVDKASSAEAFINKMTNFDLYLPEEKVLPKHSLLYETFAVYNELTKVKFIAEGLR<br>DYQFLDSGQKKQIVNQLFKEKRKVTEKDIIQFLHNVDGYDGIELKGIEKQFNASLATYHDLLKIIKD<br>KEFMDDPKNEEILENIIHTLTIFEDREMIKQRLAQYDSLFDEKVIKALTRRHYTGWGKLSAKLINGIC<br>DKQTGKTILDYLIDDGFSNRNFMQLINDDTLPFKQIIQKAQIVGDVDDIEQVVHDLPGSPAIKKGILQ<br>SIKIVDELVKVMGHNPDNIVIEMARENQTTNRGRSQSQQRLKKLQDSLKELGSNILNEEKPSYIESK<br>VENSQLQNDRLFLYYIQNGKDMYTGDELDIDRLSDYDIDHIIPQAFIKDDSIDNRVLTSSAKNRGKS<br>DDVPSLEVVKKRKTFWHQLLKSKLISQRKFDNLTKAERGGLTEKDKAGFIKRQLVETRQITKHVA<br>QILDSRFNTKRDENDKVIRDVKVITLKSNLVSQFRKDFGFYKVREINDYHHAHDAYLNAVVGTAL<br>LKKYPKLAPEFVYGEYKKYDVRKIVRSKDESSLGKATAKMFFYSNLMNFFKKEVRLSDGTVIVRP<br>VIEYSKDTGEIAWNKEKDFATVRKVLSCPQVNIVKKTEVQTGGFSKESILPKRNSDKLIPRKKNWD<br>PKKYGGFDSPTVAYSVLVVAKVEKGKSKKLKSVKELVGITIMERSSFEKDPIDFLEAKGYKEVRKD<br>LIIKLPKYSLFELENGRKRMLASAGELQKGNELALPSKYVNFLYLASHYEKLKGSPEDNEQKQLFV<br>EQHKHYLDEIIEQISEFSERVILADANLDKVLSAYNKHRDKPIREQAENIIHLFTLTNLGAPAAFKFF<br>DTTIDRKRYTSTKEVLDATLIHQSITGLYETRIDLSKLGGD |
| 297 | MNKPYSIGLDIGTNSVGWSVVDDDYKVPAKKMRVFGDTDKGHIKKNMLGTLLFDSGETAESRRL<br>KRTARRRYTRRRNRILYLQEIFAKEMAKVDESFFHRLDESFLTDDDKTFDSHPIFGNKAEEDAYHQ<br>QFPTIYHLRKHLADSTEKADLRLVYLALAHMIKFRGHFLIEGELNAENTDVQKLFADFVGVYDRTF<br>DDSHLSEITVDASSILTEKISKSRRLEKLIKHYPTEKKNTLFGNLVALALGLQPNFKTNFKLSEDAKL |

| SEQ ID NO | Nuclease Sequence |
|---|---|
| | QFSKDTYEEDLEELLGKIGDDYADLFTSAKNLYDAILLSGILTVDDESTKAPLSASMIKRYAEHHED<br>LEKLKEFVKANKPELYHDIFKDETKNGYAGYIENGVKQDEFYKYLKSTLSKQDGSQYFLDKIERED<br>FLRKQRTFDNGSIPHQLHLKEMRSILHRQGEYYPFLKENQAKIEKILTFRIPYYVGPLARKDSRFAW<br>AEYHSDEPITPWNFDEVVDKEKSAEKFITRMTLNDLYLPEEKVLPKHSHVYETYTVYNELTKVKY<br>VNEQGEAKFFDANMKQEIFDHVFKENRKVTKDKLMNFLGKEFDEFRIVDITGLDKENKAFNASLG<br>TYHDLKKILDKSFLDDKENETIIEDIIQTLTLFEDKDMIRQRLQKYSDIFTPQQLKKLERRHYTGWGR<br>LSYKLINGIRDKQTGKTILGYLIDDGYANRNFMQLINDDTLPFKEIIQKAQIIGDIDDIKAVVHDLPGS<br>PAIKKGILQSVKIVDELVKVMGHNPDNIVIEMARENQTTNRGRTQSQQRLKKLQESLKELGSNILNE<br>KKPSYVEDKVENSHLQNDRLFLYYIQNGKDMYTGDELDIDHLSDYDIDHIIPQAFIKDDSIDNRVLT<br>SSAKNRGKSDDVPSIEIVRDRKADWMRLRKAGLISKRKFDNLTKAERGGLTEADKAGFIKRQLVET<br>RQITKHVAQILDSRENTERDENDKVIRDVKVITLKSNLVSQFRKDFQFYKVREINDYHHAHDAYLN<br>AVVGTALIKKYPKLESEFVYGDYKVYDVRKMIAKSEQEIGKATAKRFFYSNIMNFFKTEIKLANGE<br>IRKRPLIETNEETGEIVWNKEKDFATVRKVLSCPQVNIVKKTEVQTGGFSKESILPKRNSDKLIPRKK<br>NWDPKKYGGFDSPTVAYSVLVVAKVEKGKSKKLKSVKELVGITIMERSSFEKNPVDFLEAKGYKE<br>VRKDLIIKLPKYSLFELENGRKRLLASAGELQKGNELALPSKYVNFLYLASHYEKLKGSPEDNEQK<br>QLFVEQHKYYLDELIDQISDFSKRVILADANLDKLLSAYNNHRDKPIREQAENIIHLFTLTNLGAPA<br>AFKFFDTTIDRKRYTSTKEILDATLIHQSVTGLYETRIDLSQLGGD |
| 298 | MKKPYSIGLDIGTNSVGWAVVDDDYKVPAKKMRVFGDTDRSHIKKNLLGTLLFDDGNTAESRRL<br>KRTARRRYTRRRNRILYLQEIFAEEMNKVDESFFHRLDDSFLVPEDKRGSKYPIFATLEEEKEYHKK<br>FPTIYHLRKHLADSKEKTDLRLIYLALAHMIKYRGHFLYEESFDIKNNDIQKIFNEFISLYDNTFEGSS<br>LSGQNAQVEAIFTDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHEEDLAA<br>LKQFVKANLPEKYDEVFSDQSKDGYAGYIDGKTTQEAFYKYIKNLLSKLEGADYFLDKIEREDFLR<br>KQRTFDNGSIPHQIHLQEMNAILRRQGEHYPFLKDNKEKIEKILTFRIPYYVGPLARGNRDFAWLTR<br>NSDQAIRPWNFEEVVDKASSAEDFINKMTNYDLYLPEEKVLPKHSLLYETFAVYNELTKVKFIAEG<br>LRDYQFLDSGQKKQIVNQLFKTKRKVTEKDIINYLHKVDGYDGVEISGVEDRFNASLGTYHDLLKI<br>IKDKSFLDDKKNEEIIEDIVLTLTLFEDRDMIRQRLQKYSDIFTPQQLKKLERRHYTGWGRLSYKLIN<br>GIRNKENNKSILDYLIDDGYANRNFMQLINDDTLPFKQIKSQVVGDIDDIKTVVHDLPGSPAIKK<br>GILQSVKIVDELVKVMGHNPDNIVIEMARENQTTNRGRSQSQQRLKKLQESLKELGSNILNVEKPS<br>YIEDKVENNHLQNDKLFLYYIQNGKDMYTGEELDIDHLSDYDIDHIIPQAFIKDDSIDNRVLTSSAK<br>NRGKSDDVPSLDIVRGRKAEWIRLYKAKLISQRKFDNLTKAERGGLTENDKAGFIKRQLVETRQIT<br>KHVAQILDARFNTKRDENDKLIREVKVITLKSNLVSQFRKEINDYHHAHDAYLNAVV<br>GTAILKKYPKLTSEFVYGEYKKYDIRKFIKSDDHSEMGKATAKYFFYSNLLNFFKEEIKYANGKIVV<br>RPVVEYSKDTGEIAWNKEKDFATVRKVLSCPQVNIVKKTEVQTGGFSKESILPKRNSDKLIARKKD<br>WDPKKYGGFDSPTVAYSVLVVAKVEKGKSKKLKSVKELLGITIMERSSFEKNPIDFLEAKGYKEVR<br>KDLIIKLPKYSLFELENGRKRMLASAGELQKGNELALPSKYVNFLYLASHYEKLKGSPEDNEQKQL<br>FVEQHKYYLDEIIEQISEFSKRVILADANLDKVLSAYNKHRDKPIREQAENIIHLFTLTNLGAPAAFK<br>YFDTTIDRKRYTSTKEVLDATLIHQSITGLYETRIDLSQLGGD |
| 299 | MKKPYSIGLDIGTNSVGWAVVDDDYKVPAKKMRVFGDTDRSHIKKNLLGTLLFDDGNTAESRRL<br>KRTARRRYTRRRNRILYLQEIFAEEMNKVDESFFHRLDDSFLVPEDKRGSKYPIFATLEEEKEYHKK<br>FPTIYHLRKHLADSKEKTDLRLIYLALAHMIKYRGHFLYEESFDIKNNDIQKIFNEFISLYDNTFEGSS<br>LSGQNAQVEAIFTDKISKSAKRERVLKLFPDEKSTGLFSEFLKLIVGNQADFKKHFDLEEKAPLQFS<br>KDTYDEDLENLLGQIGDDFADLFLVAKKLYDAILLSGILTVTDPSTKAPLSASMIERYENHEEDLAA<br>LKQFVKANLPEKYDEVFSDQSKDGYAGYIDGKTTQEAFYKYIKNLLSKLEGADYFLDKIEREDFLR<br>KQRTFDNGSIPHQIHLQEMNAILRRQGEHYPFLKDNKEKIEKILTFRIPYYVGPLARGNRDFAWLTR<br>NSDQAIRPWNFEEVVDKASSAEDFINKMTNYDLYLPEEKVLPKHSLLYETFAVYNELTKVKFIAEG<br>LRDYQFLDSGQKKQIVNQLFKTKRKVTEKDIINYLHKVDGYDGVEISGVEDRFNASLGTYHDLLKI<br>IKDKSFLDDKKNEEIIEDIVLTLTLFEDRDMIRQRLQKYSDIFTPQQLKKLERRHYTGWGRLSYKLIN<br>GIRNKENNKSILDYLIDDGYANRNFMQLINDDTLPFKQIIQKSQVVGDIDDIKTVVHDLPGSPAIKK<br>GILQSVKIVDELVKVMGHNPDNIVIEMARENQTTNRGRSQSQQRLKKLQESLKELGSNILNVEKPS<br>YIEDKVENNHLQNDKLFLYYIQNGKDMYTGEELDIDHLSDYDIDHIIPQAFIKDDSIDNRVLTSSAK<br>NRGKSDDVPSLDIVRGRKAEWIRLYKAKLISQRKFDNLTKAERGGLTENDKAGFIKRQLVETRQIT<br>KHVAQILDARFNTKRDENDKLIREVKVITLKSNLVSQFRKEFGFYKVREINDYHHAHDAYLNAVV<br>GTAILKKYPKLTSEFVYGEYKKYDIRKFIKSDDHSEMGKATAKYFFYSNLLNFFKEEIKYANGKIVV<br>RPVVEYSKDTGEIAWNKEKDFATVRKVLSCPQVNIVKKTEVQTGGFSKESILPKRNSDKLIPRKKG<br>WDPKKYGGFDSPTVAYSVLVVAKVEKGKSKKLKSVKELVGITIMERSSFEKDPVDFLEAKGYKEV<br>RKDLIIKLPKYSLFELENGRKRMLASAGELQKGNELALPSKYVNFLYLASHYEKLKGSPEDNEQKQ<br>LFVEQHKYYLDEIVEQISEFSERVILADANLDKVLSAYNKNRDRPIREQAENIIHLFTLTNLGAPAAF<br>KFFNTDIDRKRYTSTKEILDATLIHQSITGLYETRIDLSQLGGD |
| 300 | MKKPYSIGLDIGTNSVGWAVVTDDYKVPAKKMKVLGDTDKSHIKKNLLGTLLFESGETAEGRRLK<br>RTARRRYTRRRNRILYLQEIFAEEMNKVDDSFFQRLDESFLKDDDKNFDSHPIFGNKAEEDAYHQK<br>FPTIYHLRQYLADSPEKADLRLVYLALAHIIKYRGHELFEGDLKSENKDVQHLFNDFVEMEDKTVE<br>GSYLSENLPNVADVLVEKVSKSRRLENVLHYFPNEKKNGLFGNFIALALGLQPNFKTNFKLSEDAK<br>LQFSKDTYEDLEELLGKIGDDYADLFVAAKNLYDAILLSGILTVTDPTTKAPLSASMIDRYEKHH<br>KDLALLKNLIKQNLTQEKYDEVFSDESKNGYAGYISGKVKQEEFYKYLKNTLSKIEGSDYFLDKIE<br>REDFLRKQRTFDNGSIPHQIHLQEMNAIIRRQGEHYPFLKENKEKIEKILTFRIPYYVGPLARGNRDF<br>AWLTRNSDQAIRPWNFEEIVDQASSAEDFINKMTNYDLYLPEEKVLPKHSLLYETFAVYNELTKV<br>FIAEGLRDYQFLDSGQKKQIVNQLFKEKRKVTEKDIIQYLHNVDGYDGIELKGIEKQFNASLSTYHD<br>LLKIIKDKEFMDDPKNEEILENIVHTLTIFEDREMIKQRLAQYDSLFDEKVIKALTRRHYTGWGKLS<br>AKLINGIYDKQSKKTILDYLIDDGEINRNFMQLINDDGLSFKDIIQKAQVVGKTNDVKQVVQELPGS<br>PAIKKGILQSIKLVDELVKVMGHAPESIVIEMARENQTTARGKKNSQQRYKRIEDALKNLAPGLDS |

| SEQ ID NO | Nuclease Sequence |
|---|---|
| | NILKENPTDNIQLQNDRLFLYYLQNGKDMYTGEALDINQLSNYDIDHIVPQAFIKDDSLDNRVLTSS
KDNRGKSDNVPSIEVVQKRKAFWQQLLDSKLISERKENNLTKAERGGLDERDKVGFIKRQLVETR
QITKHVAQILDARFNTEVDENNQRIRKVKIITLKSNLVSNFRKEFGLYKVREINDYHHAHDAYLNA
VVAKAILKKYPKLEPEFVYGDYQKYDLKRYISRSKDPKDIEKATEKYFFYSNLLNFFKEEVHYADG
TIIKRENIEYSNDTGEIAWNKEKDFATVRKVLSCPQVNIVKKTEEQTGGFSKESILPKRNSDKLIPRK
TEWDPKKYGGFDSPIVAYSVLVVAKVEKGKSKKLKSVKELVGITIMERSSFEKDPIDFLEAKGYKE
VRKDLIIKLPKYSLFELENGRKRMLASAGELQKGNELALPSKYVNFLYLASHYEKLKGSPEDNEQK
QLFVEQHKHYLDEIVEQISEFSERVILADANLDKVLSAYNKHRDKPIREQAENIIHLFTLTNLGAPAA
FKFFNTDIDRKRYTSTKEVLDATLIHQSITGLYETRIDLSQLGGD |
| 301 | MKKPYSIGLDIGTNSVGWAVVTDDYKVPAKKMKVLGDTDKSHIKKNLLGTLLFESGETAEGRRLK
RTARRRYTRRRNRILYLQEIFAEEMNKVDDSFFQRLDESFLKDDDKNFDSHPIFGNKAEEDAYHQK
FPTIYHLRQYLADSPEKADLRLVYLALAHIIKYRGHELFEGDLKSENKDVQHLFNDFVEMEDKTVE
GSYLSENLPNVADVLVEKVSKSRRLENVLHYFPNEKKNGLFGNFIALALGLQPNFKTNFKLSEDAK
LQFSKDTYDEDLEELLGKIGDDYADLFVAAKNLYDAILLSGILTVTDPTTKAPLSASMIDRYEKHH
KDLALLKNLIKQNLTQEKYDEVFSDESKNGYAGYISGKVKQEEFYKYLKNTLSKIEGSDYFLDKIE
REDFLRKQRTFDNGSIPHQIHLQEMNAIIRRQGEHYPFLKENKEKIEKILTFRIPYYVGPLARGNRDF
AWLTRNSDQAIRPWNFEEIVDQASSAEDFINKMTNYDLYLPEEKVLPKHSLLYETFAVYNELTKVK
FIAEGLRDYQFLDSGQKKQIVNQLFKEKRKVTEKDIIQYLHNVDGYDGIELKGIEKQFNASLSTYHD
LLKIIKDKEFMDDPKNEEILENIVHTLTIFEDREMIKQRLAQYDSLFDEKVIKALTRRHYTGWGKLS
AKLINGIYDKQSKKTILDYLIDDGEINRNFMQLINDDGLSFKDIQKAQVVGKTNDVKQVVQELPGS
PAIKKGILQSIKLVDELVKVMGHAPESIVIEMARENQTTARGKKNSQQRYKRIEDALKNLAPGLDS
NILKENPTDNIQLQNDRLFLYYLQNGKDMYTGEALDINQLSNYDIDHIVPQAFIKDDSLDNRVLTSS
KDNRGKSDNVPSIEVVQKRKAFWQQLLDSKLISERKENNLTKAERGGLDERDKVGFIKRQLVETR
QITKHVAQILDARFNTEVDENNQRIRKVKIITLKSNLVSNFRKEFGLYKVREINDYHHAHDAYLNA
VVAKAILKKYPKLEPEFVYGDYQKYDLKRYISRSKDPKDIEKATEKYFFYSNLLNFFKEEVHYADG
TIIKRENIEYSNDTGEIAWNKEKDFATVRKVLSCPQVNIVKKTEVQTGGFSKESILPKRNSDKLIPRK
KGWDPKKYGGFDSPTVAYSVLVVAKVEKGKSKKLKSVKELVGITIMERSSFEKDPVDFLEAKGYK
EVRKDLIIKLPKYSLFELENGRKRMLASAGELQKGNELALPSKYVNFLYLASHYEKLKGSPEDNEQ
KQLFVEQHKHYLDEIVEQISEFSERVILADANLDKVLSAYNKNRDRPIREQAENIIHLFTLTNLGAPA
AFKFFNTDIDRKRYTSTKEILDATLIHQSITGLYETRIDLSQLGGD |
| 302 | MKKSYSIGLDIGTNSVGWAVVDDDYKVPAKKMRVFGDTDRSHIKKNLLGTLLFDEGNTAESRRL
KRTARRRYTRRRNRILYLQEIFAEEMNKVDESFFHRLDDSFLVPEDKRGSKYPIFATLQEEKEYHKQ
FPTIYHLRKQLAESNEKADLRLVYLALAHMIKYRGHFLIDDPKFKVQNNDIQGLFEKFVEEYDNVQ
ETSLSKIKLNVTEILTANIPKSEKQEQLLKNYPSEKKNTLFGNLIGLALGLTPNFKTNFSLENDAKLQI
SSESYEEDLGSLLALIGENFIELFSAVKNLSDGILLAGIVSDESPHAPLSTKMVIRFKEHEEDLAALKH
FIKTNLPEKYDEVFSDDSKNGYAGYVGVDSKVRKRNGKLATEEEFYKYLKEILNNVKGADYFLEK
IKREDLLRKQRTFDNGTIPYQVHLTEMKAIIHRQGEHYPFLQENKEKIEKILTFRIPYYVGPLARGNR
DFAWLTRNSDQAIRPWNFEEIVDQASSAEDFINKMTNYDLYLPEEKVLPKHSLLYETFAVYNELTK
VKFIAEGLRDYQFLDSGQKKQIVNQLFKEKRKVTEKDIIHYLHNVDGYDGIELKGIEKQFNASLSTY
HDLLKIIKDKEFMDDPKNEEILENIVHTLTIFEDREMIKQRLAQYDSLFDEKVIKALTRRHYTGWGK
LSAKLINGICDKKTGKTILDYLIDDDKINRNFMQLINDDGLSFKEIIQKAQVVGKTDDVKQVVQELP
GSPAIKKGILQSIKIVDELVKVMGHAPESIVIEMARENQTTARGKKNSQQRYKRIEDALKNLAPGLD
SNILKENPTDNIQLQNDRLFLYYLQNGKDMYTGEALDINQLSSYDIDHIVPQAFIKDDSLDNRVLTS
SKDNRGKSDNVPSIEVVQKRKAFWQQLLDSKLISERKENNLTKAERGGLDERDKVGFIKRQLVETR
QITKHVAQILDARFNTEVNEKGQKIRKVKIITLKSNLVSNFRKEFGLYKVREINDYHHAHDAYLNA
VVAKAILKKYPKLEPEFVYGDYQKYDIKRYISRSKDPKEIEKATEKYFFYSNLLNFFKEEVHYADG
TIVKRENIEYSKDTGEIAWNKEKDFATVRKVLSCPQVNIVKKTEVQTGGFSKESILPKRNSDKLIAR
KKDWDPKKYGGFDSPTVAYSVLVVAKVEKGKSKKLKSVKELLGITIMERSSFEKNPIDFLEAKGY
KEVRKDLIIKLPKYSLFELENGRKRMLASAGELQKGNELALPSKYVNFLYLASHYEKLKGSPEDNE
QKQLFVEQHKHYLDEIIEQISEFSKRVILADANLDKVLSAYNKHRDKPIREQAENIIHLFTLTNLGAP
AAFKYFDTTIDRKRYTSTKEVLDATLIHQSITGLYETRIDLSQLGGD |
| 303 | MKKPYSIGLDIGTNSVGWAVVTDDYKVPAKKMKVLGNTDKSHIKKNLLGALLFDSGETAEGRRL
KRTARRRYTRRRNRILYLQEIFAEEMNKIDESFFHRLDDSFLVPEDKRGSKYPIFATLEEEKEYHKK
FPTIYHLRKHLAESNEKADLRLVYLALAHMIKYRGHFLIDDPKFKVQNNDIQGLFEKFVEEYDNVQ
ETSLSKIKLNVTEILTANIPKSEKQEQLLKNYPSEKKNTLFGNLIGLALGLTPNFKTNFSLENDAKLQI
SSESYEEDLGNLLALIGENFIELFSAVKNLSDGILLAGIVSDESPHAPLSTKMVIRFKEHEEDLAALK
HFIKANLPEKYDEVFSDDSKNGYAGYVGVDSKVRKRNGKLATEEEFYKYLKDILNNVKGADYFLE
KIKREDLLRKQRTFDNGTIPYQVHLSEMKAIIHRQGEHYPFLKENKEKIEKILTFRIPYYVGPLARGN
RDFAWLTRNSDQAIRPWNFEEIVDKASSAEDFINKMTNYDLYLPEEKVLPKHSLLYETFAVYNELT
KVKFIAEGLRDYQFLDSGQKKQIVNQLFKEKRKVTEKDIIHYLHNVDGYDGIELKGIEKQFNASLST
YHDLLKIIKDKEFMDDPKNEEILENIVHTLTIFEDREMIKQRLAQYDSLFDEKVIKALTRRHYTGWG
KLSAKLINGIYDKQSKKTILDYLIDDGEINRNFMQLIHDDGLSFKEIIQKAQVFGKTDDVKQVVQEL
PGSPAIKKGILQSIKIVDELVKVMGHAPESIVIEMARENQTTARGKKNSQQRYKRIEDSLKNLASGL
DSNILKENPTDNVQLQNDRLFLYYLQNGKDMYTGEALDINQLSNYDIDHIIPQAFIKDDSLDNRVLT
SSKDNRGKSDNVPSIEVVEKMKAFWQQLLDSKLISERKYNNLTKAERERGGLNELDKVGFIKRQL
VETRQITKHVAQILDARFNTEVNENNQKIRKVKIITLKSNLVSNFRKEFGLYKVREINDYHHAHDA
YLNAVVAKAILKKYPKLEPEFVYGDYQKYDIKRYISRSKDPKDIEKATEKYFFYSNLLNFFKEEVH
YADGTIIKRENIEYSKDTGEIAWNKEKDFATVRKVLSCPQVNIVKKTEVQTGGFSKESILPKRNSDK
LIARKKDWDPKKYGGFDSPTVAYSVLVVAKVEKGKSKKLKSVKELVGITIMERSSFEKDPVDFLE |

-continued

Sequences

| SEQ ID NO | Nuclease Sequence |
|---|---|
| | AKGYKEVRKDLIIKLPKYSLFELENGRKRMLASAGELQKGNELALPSKYVNFLYLASHYEKLKGSP<br>EDNEQKQLFVEQHKHYLDEIIEQISEFSKRVILADANLDKVLSAYNKHRDKPIREQAENIIHLFTLTN<br>LGAPAAFKYFDTTIDRKYTSTKEVLDATLIHQSITGLYETRIDLSQLGGD |
| 304 | MKKPYSIGLDIGTNSVGWAVVTDDYKVPAKKMKVLGNTDKSHIKKNLLGTLLFDSGETAEGRRL<br>KRTARRRYTRRRNRILYLQEIFAEEMNKVDESFFHRLDDSFLVPEDKRGSKYPIFGTLEEEKEYHKQ<br>FPTIYHLRKQLAESNEKADLRLVYLALAHMIKYRGHFLIDDPKFKVQNNDIQGLFEKFVEEYDNVQ<br>ETSLSKIKLNVTEILTANIPKSEKQEQLLKNYPSEKKNTLFGNLIGLALGLTPNFKTNFSLENDAKLQI<br>SSESYEEDLGNLLALIGENFIELFSAVKNLSDGILLAGIVSDETPHAPLSTKMVIRFKEHEEDLAALK<br>HFIKANLPEKYDEVFSDDSKNGYAGYVGVDSKVRKRNGKLATEEEFYKYLKEILNNVKGADYFLE<br>KIKREDLLRKQRTFDNGTIPYQVHLSEMKAIIHRQGEHYPFLQENKEKIEKILTFRIPYYVGPLARGN<br>RDFAWLTRNSDQAIRPWNFEEIVDQASSAEDFINKMTNYDLYLPEEKVLPKHSLLYETFAVYNELT<br>KVKFIAEGLRDYQFLDSGQKKQIVNQLFKEKRKVTEKDIIHYLHNVDGYDGIELKGIEKQFNASLST<br>YHDLLKIIKDKEFMDDPKNEEILENIVHTLTIFEDREMIKQRLAQYDSLFDEKVIKALTRRHYTGWG<br>KLSAKLINGIRDKQSNKTILDYLIDDDKINRNFMQLINDDGLSFKEIIQKAQVVGKTDDVKQVVQEL<br>PGSPAIKKGILQSIKIVDELVKVMGHAPESIVIEMARENQTTARGKKNSQQRYKRIEDALKNLAPGL<br>DSNILKENPTDNIQLQNDRLFLYYLQNGKDMYTGNPLDINQLSSYDIDHIVPQAFIKDDSLDNRVLT<br>SSKDNRGKSDNVPSIEVVQKRKAFWQQLLDSKLISERKENNLTKAERGGLDERDKVGFIKRQLVET<br>RQITKHVAQILDARFNTEVNEKNQKIRSVKIITLKSNLVSNFRKEFRLYKVREINDYHHAHDAYLNA<br>VVAKAILKKYPKLEPEFVYGDYQKYDIKRYISRSKDPKDIEKATEKYFFYSNLLNFFKEEVHYADG<br>TIIKRENIEYSKDTGEIAWNKEKDFATVRKVLSCPQVNIVKKTEVQTGGFSKESILPKRNSDKLIARK<br>KDWDPKKYGGFDSPTVAYSVLVVAKVEKGKSKKLKSVKELVGITIMERSSFEKDPVDFLEAKGYK<br>EVRKDLIIKLPKYSLFELENGRKRMLASAGELQKGNELALPSKYVNFLYLASHYEKLKGSPEDNEQ<br>KQLFVEQHKHYLDEIIEQISEFSKRVILADANLDKVLSAYNKHRDKPIREQAENIIHLFTLTNLGAPA<br>AFKYFDTTIDRKYTSTKEVLDATLIHQSITGLYETRIDLSQLGGD |

| SEQ ID NO | gRNA Scaffold Sequence (shown as DNA) |
|---|---|
| 305 | gttttagagctgtgttgaaaaacacagcaagttaaaataaggctttgtccgt<br>atccaacttgaaaaagtgcgcaccgattcggtgcttttttgttttacta |
| 306 | gttttagagctgtgttgaaaaacacagcaagttaaaataaggctttgtccgta<br>tccaacttgaaaaagtgagcaccgattcggtgcttttttgtgccca |
| 307 | gttttagagctgtgttgaaaaacacagcaagttaaaataaggctttgtccgta<br>cacaacttgaaaaagtgagcaccgattcggtgcttttttgtgccta |
| 308 | gttttagagctgtgttgaaaaacacagcaagttaaaataaggctttgtccgta<br>cacaacttgaaaaagtgagcaccgattcggtgcttttttgtgccca |
| 309 | gttttagagctgtgttgaaaaacacagcaagttaaaataaggctttgtccgta<br>cacaacttgaaaaagtgagcaccgattcggtgcttttttgttttcta |
| 310 | gttttagagctgtgttgaaaaacacagcaagttaaaataaggctttgtccgta<br>cacaacttgaaaaagtgcgcaccgattcggtgcttttttgtgcctt |
| 311 | gttttagagctgtgttgaaaaacacagcaagttaaaataaggctttgtccgta<br>cacaacttgaaaaagtgagcaccgattcggtgcttttttgtatacaaa |
| 312 | gttttagagctgtgttgaaaaacacagcaagttaaaataaggctttgtccgt<br>acacaacttgaaaaagtgcgcaccgattcggtgcttttttgttttacta |
| 313 | gttttagagctgtgttgaaaaacacagcaagttaaaataaggctttgtccgta<br>tccaacttgaaaaagtgcgcaccgattcggtgctttttttgtgccc |
| 314 | gttttagagctgtgttgaaaaacacagcaagttaaaataaggcttagtccgta<br>ttcaacttgaaaaagtgcgcaccgattcggtgcttttttgttttacta |
| 315 | gttttagagctgtgttgaaaaacacagcaagttaaaataaggcttagtccgta<br>cacaacttgaaaaagtgcgcaccgattcggtgcttttttgtgccc |
| 316 | gttttagagctgtgttgaaaaacacagcaagttaaaataaggctttgtccgta<br>cacaacttgaaaaagtgagcaccgattcggtgcttttttgttttacta |
| 317 | gttttagagctgtgttgaaaaacacagcaagttaaaataaggctttgtccgt<br>acacaacttgaaaaagtgagcaccgattcggtgcttttttgttttacacaac |
| 318 | gttttagagctgtgttgaaaaacacagcaagttaaaataaggctttgtccgta<br>cacaacttgaaaaagtgagcaccgattcggtgcttttttattttata |

-continued

| SEQ ID NO | gRNA Scaffold Sequence (shown as DNA) |
|---|---|
| 319 | gttttagagctgtgttgaaaaacacagcaagttaaaataaggctttgtccgtacacaacttgaaaaagtgcgcaccgattcggtgcttttttgtgccc |
| 320 | gttttagagctgtgttgaaaaacacagcaagttaaaataaggctttgtccgtacacaacttgaaaaagtgagcaccgattcggtgcttttttgtgccta |
| 321 | gttttagagctgtgctgaaaaacacagcgagttaaaataaggctttgtccgtacacaacttgaaaaagtggcaccgattcggtgcttttttatttat |
| 322 | gttttagagctgtgctgaaaaacacagcaagttaaaataaggctttgtccgtacacaacttgtaaaagtgagcaccgattcggtgcttttttgttgctt |
| 323 | gttttagagctgtgttgaaaaacacagcaagttaaaataaggctttgtccgtacacaacttgaaaaagtgagcaccgattcggtgcttttttgtataca |
| 324 | gttttagagctgtgctgaaaaacacagcgagttaaaataaggctttgtccgtacacaacttgtaaaagtgagcaccgattcggtgcttttttatttgct |
| 325 | gttttagagctgtgctgaaaaacacagcgagttaaaataaggctttgtccgtacacaacttgaaaaagtgagcaccgattcggtgcttttttttt |
| 326 | gttttagagctgtgctgaaaaacacagcgagttaaaataaggctttgtccgtacacaacttgaaaaagtgcgcaccgattcggtgcttttttgttatttt |
| 327 | gttttagagctgtgctgaaaaacacagcgagttaaaataaggctttgtccgtacacaacttgaaaaagtggcaccgattcggtgcttttttgttttatgccc |
| 328 | gttttagagctgtgttgaaaaacacagcgagttaaaataaggctttgtccgtacacaacttgaaaaagtgagcaccgattcggtgcttttttgttttatgcctca |
| 329 | gttttagagctgtgctgaaaaacacagtgagttaaaataaggctttgtccgtacacaacttgaaaaagtgagcaccgattcggtgcttttttgttgctca |
| 330 | gttttagagctgtgctgaaaaacacagcgagttaaaataaggctttgtccgtacacaacttgaaaaagtgcgcaccgattcggtgcttttttgttttctt |
| 331 | gttttagagctgtgctgaaaaacacagcgagttaaaataaggtttagtccgtacacaacttgaaaaagtgagcaccgattcggtgcttttttgttttctt |
| 332 | gttttagagctgtgctgaaaaacacagcgagttaaaataaggctttgtccgtacacaacttgtttaagtgcgcaccgattcggtgcttttttgttttata |
| 333 | gttttagagctgtgctgaaaaacacagttagttaaaataaggctttgtccgtacacaacttgaaaaagtgagcaccgattcggtgcttttttgttttctt |
| 334 | gttttagagctgtgttgaaaaacatagcaagttaaaataaggctttgtccgtacacaacttgaaaaagtgcgcaccgattcggtgcttttttgttttacta |
| 335 | gttttagagctgtgctgaaaaacacagcgagttaaaataaggctttgtccgtacacactttgaaaaagtgcgcaccgattcggtgcttttttgttttatt |
| 336 | gttttagagctgtgctgaaaaacacagcgagttaaaataaggctttgtccgtacacaacttgaaaaagtgagcaccgattcggtgcttttttattttgact |
| 337 | gttttagagctgtgctgaaaaacacagcgagttaaaataaggctttgtccgtacacaacttgttaaagtggcacccgattcgggtgcttttttattttct |
| 338 | gttttagagctgtgttgaaaaacacagtgagttaaaataaggctttgtccgtacacaacttaaaaaagtggcacccgattcgggtgcttttttattttc |
| 339 | gttttagagctgtgctgaaaaacacagcgagttaaaataaggctttgtccgtacacaacttaaaaaagtggcacccgattcgggtgctttttttattttaaa |
| 340 | gttttagagctgtgctgaaaaacacagcaagttaaaataaggctttgtccgtacacaacttgtaaaagtggcacccgattcggatgcgtttttatttgtgt |
| 341 | gttttagagctgtgctgaaaaacacagcaagttaaaataaggctttgtccgtacacaacttaaaaaagtggcacccgattcgggtgcatttttgtgcttt |
| 342 | gttttagagctgtgctgaaaaacacagcaagttaaaataaggctttgtccgtacacaacttgtaaaagtggcacccgattcgggtgcttttttattttatt |
| 343 | gttttagagctgtgctgaaaaacacagcaagttaaaataaggctttgtccgtacacaacttaaaaaagtgagcaccgattcggtgcttttttattttct |

-continued

| SEQ ID NO | gRNA Scaffold Sequence (shown as DNA) |
|---|---|
| 344 | gttttagagctgtgctgaaaaacacagcaagttaaaataaggctttgtccgta cacaacttgtgaaagtaagcaccgattcggtgcttttttgttttcta |
| 345 | gttttagagctgtgttgaaaaacacagcaagttaaaataaggctttgtccgta cacaacttgaaaaagtgagcaccgattcggtgctttttttgtgcctt |
| 346 | gttttagagctgtgttgaaaaacacagcgagttaaaataaggctttgtccgta cacaacttgtaaaagtggcacccgattcgggtgcttttttttattttcct |
| 347 | gttttagagctgtgctgaaaaacacagcgagttaaaataaggctttgtccgta cacaacttgtaaaagtggcacccgattcgggtgccttttaattttctt |
| 348 | gttttagagctgtgctgaaaaacacagtgagttaaaataaggctttgtccgta cacaacttgtaaaagtggcacccgattcgggtgcattttttattttct |
| 349 | gttttagagctgtgctgaaaaacacagcgagttaaaataaggctttgtccgta cacaacttataaaagtgcgcaccgattcggtgcttttttattttatt |
| 350 | gttttagagctgtgctgaaaaacacagcaagttaaaataaggctttgtccgta cacaacttaaaaaagtggcaccccgattcggatgcgttttttgtgtacat |
| 351 | gttttagagctgtgctgaaaaacacagcgagttaaaataaggctttgtccgta cacaacttgtaaaagtgagcaccgattcggtgctttttttattttttct |
| 352 | gttttagagctgtgttgaaaaacacagcgagttaaaataaggctttgtccgta cacaacttgtaaaagtgagcaccgattcggtgcttttttattttatt |
| 353 | gttttagagctgtgctgaaaaacacagcgagttaaaataaggctttgtccgta cacaacttgtaaaagtgagcaccgattcggtgctttttttgttgaca |
| 354 | gttttagagctgtgctgaaaaacacagcaagttaaaataaggctttgtccgta cacaacttgtaaaagtggcacccgattcgggtgcatttttttgtgtgt |
| 355 | gttttagagctgtgttgaaaaacacagcgagttaaaataaggctttgtccgta cacaacttgaaaaagtgcgcaccgattcggtgctttttttgttgcgta |
| 356 | gttttagagctgtgttgaaaaacacagcgagttaaaataaggctttgtccgta cacaacttgtaaaagtggcacccgattcgggtgcatttttttattttaaca |
| 357 | gttttagagctgtgctgaaaaacacagtgagttaaaataaggctttgtccgta cacaacttgtaaaaggtgcgcaccgattcggtgcttttttttattttct |
| 358 | gttttagagctgtgttgaaaaacacagcgagttaaaataaggctttgtccgta cacattttggcaaagtgagcaccgattcggtgctttttttattttatt |
| 359 | gttttagagctgtgctgaaaaacacagcaagttaaaataaggctttgtccgta cacaacttaaaaaagtggcaccccgattcggtgcttttttttattttct |
| 360 | gttttagagctgtgctgaaaaacacagcgagttaaaataaggctagtccgtat ccaacttgaaaaagtggcaccccgattcggatgcatttttttatttgtg |
| 361 | gttttagagctgtgctgaaaaacacagcgagttaaaataaggctttgtccgta cacaacttgtaaaagtggcacccgattcggtgctttttttatttctt |
| 362 | gttttagagctgtgctgaaaaacacagcgagttaaaataaggctttgtccgta cacaacttgtaaaagtgagcaccgattcggtgtttttttattttaaca |
| 363 | gttttagagctgtgctgaaaaacacagcgagttaaaataaggctttgtccgta cacaacttgaaaaagtggcacccgattcgggtgcatttttttgtgtgt |
| 364 | gttttagagctgtgctgaaaaacacagcgagttaaaataaggctagtccgtac acaacttgtgaaagtggcacccgattcgggtgcatttttttattttct |
| 365 | gttttagagctgtgttgaaaaacacagcgagttaaaataaggctttgtccgta cacaacttttgaaaaagtgcgcaccgattcggtgcttttttattttatt |
| 366 | gttttagagctgtgttgaaaaacacagcaagttaaaataaggctttgtccgta tccaacttgaaaaagtgcgcaccgattcggtgctttttttgttttacta |
| 367 | gttttagagctgtgctgaaaaacacagcaagttaaaataaggctttgtccgta cacaacttgtaaaagtggcacccgattcgggtgcgttttttattttct |

-continued

| SEQ ID NO | gRNA Scaffold Sequence (shown as DNA) |
|---|---|
| 368 | gttttagagctgtgctgaaaaacacagtgagttaaaataaggctttgtccgta cacaacttgtaaaagtgagcaccgattcggtgcttttttttattttact |
| 369 | gttttagagctgtgctgaaaaacacagcaagttaaaataaggctttgtccgta cacaacttgtaaaagtgagcaccgattcggtgcttttttttattttctct |
| 370 | gttttagagctgtgctgaaaaacacagcaagttaaaataaggctttgtccgta cacaacttaaaaaagtggcacccgattcgggtgcattttttattttct |
| 371 | gttttagagctgtgctgaaaaacacagtgagttaaaataaggctttgtccgta cacaacttgtgaaagtacgcaccgattcggtgcttttttttattttc |
| 372 | gttttagagctgtgctgaaaaacacagcaagttaaaataaggctttgtccgta cacaacttgtaaaaggagcgccgatgcttttttttgtgccc |
| 373 | gttttagagctgtgctgaaaaacacagtgagttaaaataaggctttgtccgta cacaacttgtaaaagtggcacccaattcgggtgcgttttttattttct |
| 374 | gttttagagctgtgctgaaaaacacagcaagttaaaataaggctttgtccgta cacaacttgtaaaaggtgcgcaccgattcggtgttttttttattttacca |
| 375 | gttttagagctgtgctgaaaaacacagcaagttaaaataaggctttgtccgta cacattttggcccccccgattcgggtgcgttttttgtgccc |
| 376 | gttttagagctgtgctgaaaaacacagcaagttaaaataaggctttgtccgta cacaacttgtaaaagtggcacccgattcggatgcattttttattgtgg |
| 377 | gttttagagctgtgttgaaaaacacagcaagttaaaataaggctttgtccgta cacaacttgaaaaagtgagcaccgattcggtgcttttttgttgcgta |
| 378 | gttttagagctgtgctgaaaaacacagcaagttaaaataaggctttgtccgta cacaacttgtgaaagtacgcaccgattcggtgcttttttttatttac |
| 379 | gttttagagctgtgctgaaaaacacagcaagttaaaataaggctttgtccgta cacaacttgtaaaagtggcaccccgattcgggtgcgttttttttgtgccc |
| 380 | gttttagagctgtgctgaaaaacacagcaagttaaaataaggctttgtccgta cacaacttaaaaaagtggcgccccgattcggtgcttttttttattgtgt |
| 381 | gttttagagctgtgctgaaaaacacagcaagttaaaataaggctttgtccgta cacaacttgtaaaagtggcacccaattcgggtgcgttttttttatttctct |
| 382 | gttttagagctgtgttgaaaaacacagcaagttaaaataaggctttgtccgta cacaacttgaaaaagtgagcaccgattcggtgcttttttatttatta |
| 412 | gttttagagctaGAAAtagcaagttaaaataaggctagtccgttatcaacttg aaaaagtggcaccgagtcggtgc |

The scope of the present invention is not limited by what has been specifically shown and described hereinabove. Those skilled in the art will recognize that there are suitable alternatives to the depicted examples of materials, configurations, constructions, and dimensions. Variations, modifications, and other implementations of what is described herein will occur to those of ordinary skill in the art without departing from the spirit and scope of the invention.

Numerous references, including patents and various publications, are cited and discussed in the description of this invention. The citation and discussion of such references is provided merely to clarify the description of the present invention and is not an admission that any reference is prior art to the invention described herein. All references cited and discussed in this specification are incorporated herein by reference in their entirety.

SEQUENCE LISTING (474 sequences)

SEQ ID NO: 1 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 2 - protein, 1379 aa, synthetic construct
MKKSYSIGLDIGTNSVGWSVVTDDYKVPAKKMKVFGNTDKKYIKKNLLGALLFDSGETAEGTRLKRTARRRYTRRRNRILYLQEIFAKEMAKVDESFFQRLEESFLTDDDKNFDSHPIFGNKAEEDAYHEQFPTIYHLRKHLADSSEKADLRLVYLALAHMIKFRGHFLIEGQLKAENTNVQTLFNDFVEVYDKTVEESHLAEITVDALSILTEKVSKSRRLENLLKYYPTEKKNTLFGNLIALSLGLQPNFKTNFKLSEDAKLQFSKDTYEEDLEELLGKIGDEYADLFTSAKNLYDAILLSGILTVDDKSTKAPLSASMLKRYVEHHEDLEKLKDFVKANKPELYHDIFKDETKNGYAGYIENGVKQDEFYKYLKNTLSKIAGSDYFLDKIEREDFLRKQRTFDNGSIPHQVHLQEMRAILRRQGEYYPFLKENQAKIEKILTFRIPYYVGPLARKDSRFAWAEYHSDEKITPWNFDKVIDKESSARAFIEHMTNNDLYLPEEKVLPKHSPLYEKYTVYNELTKVKYVTEQGKSSFFDANMKQEIFEHVFKKNRKVTKDKFLNYLNKEFPEYRIHDLIGLDKENKSFNASLGTYHDLKKILDKSFLDNKENEEIIEDVVLTLTLFEDRDMIRQRLQKYSDIFTKDQLKKLERRHYTGWGRLSYKLINGIRDKQSNKTILDYLLEDDGVKKNINRNFMQLINDDSLSFKTIIQEAQVIGDIDDIKAVVHDLPGSPAIKKGILQSVKIVDELVKVMGHNPDNIVIEMARENQTTNRGRSQSQQRLKKLQESLKELGSNILNEEKPSYIEDKVENSHLQNDRLFLYYIQNGKDMYTGDELDIDHLSDYDIDHIIPQAFIKDNSIDNRVLTSSAKNRGKSDDVPSLDIVRERKADWIRLYKAGLISKRKFDNLTKAERGGLTENDKAGFIKRQLVETRQITKHVAQILDARFNTKRDENDKVIRDVKIITLKSNLVSQFRKEFGFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEVVWNKERDFAIVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDESKNGYAGYIENGVKQDEFYKYLKETLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMDFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 4 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHHKDLALLKNLIKQNLTQEKYDEVFSDESKNGYAGYISGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 5 - protein, 1368 aa, synthetic construct
MDKKYSIGLDIGTNSVGWAVITDDYKVPAKKMKVLGNTDKRTIKKNLLGALLFDSGETAEATRLKRTARRRYTRRKNRLRYLQEIFSKEMSNVDANFFYRLEDSFLVPEDKQQERHPIFGNLVEEIEYHKEFPTIYHLRKQLADSKEKADLRLIYLALAHMIKYRGHFLFEGDLKSENTDVQRLFKDFVEVYDKTVEGSYLSENLTNVTDVLVEKISKSRRLENILHYFPNEKKNGLFGNFLALALGLQPNFKNNFDLAEEAKLQISKDTYEEELEVLLAQIGDNYAELFIATKELYDGILLAGILTVTDSSTKAPLSASMIERYENHQGDLAKLKAFIRRFCKETYDEVFSDEVKDGYAGYIEGKTSQEDFYVHLKKLLANLEGADYFLEKINREDLLRKQRTFDNGSIPYQIHLVEMRAILDKQAKFYPFLAKNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLMGLDKENKAFNASYGTYHDLRKILDKDFLDNSDNEKILEDIVLTLTLFEDREMIRKRLEKYKDIFTEKQRKQLERRHYTGWGRLSAKLIHGIRNKESRKTILDYLIDDGYSNRNFMQLINDDTLTFKEEIAKAQVVGETDSLKQFISELAGSPAIKKGILQTVKIVDELVKVMGHKPENIVIEMARENQTTQKGQKNSQERMKRIEEGIKELGSQILKEHPVENTQLQNEKLYLYYLQNGRDMYVDQELDINRLSDYDIDHIIPQAFIKDDSIDNRVLTSSKDNRGKSDNVPSEDVVKKMKNYWRQLLNAKLISQRKFDNLTKAERGGLSELDKVGFIKRQLVETRQITKHVAQILDSRMNTKYDENDKLIRDVKIITLKSKLVSDFRKDFQFYKVREINNYHHAHDAYLNAVVGTALIKKYPKLESEFVYGDYKVYDVQKMIAKSEQEIGKATAKFFFYSNIMNFFKTEITLANGEIRKRPMIETNEETGEIVWDKGRDFATVRKVLCMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 6 - protein, 1373 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMSKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRILKLFPGEKNSGIFSEFLKLIVGNQADFKKYFNLDDQASLHFSKESYDEDLETLLGHIGDDYSDVFLKAKKLYDAILLSGILTVTDNETEAPLSSAMIMRYKEHEEDLALLKAYIRNISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLSTYHDLLNIINDKEFLDDASNEAIIEEIIHTLTIFEDREMIKQRLSKFENIFDKSVLKKLSRRHYTGWGKLSAKLINGIRDEKSGKTILDYLIDDGISNRNFMQLIHDDTLSFKKKIQKAQIIGDQDNIKQVVQSLPGSPAIKKGILQSIKIVDELVKVMGRNPESIVVEMARENQYTNQGKSNSQQRLKRLEESLKELGSKILKENVPAKLSKIDNNALQNERLYLYYLQNGKDMYTGKDLDIDRLSNYDIDHIIPQAFLKDNSIDNKVLVSSASNRGKSDDVPSLDVVKKRKGFWHQLLKSKLISQRKFDNLTKAERGGLTEDDKAGFIKRQLVETRQITKHVAQILDSRFNTKRDDNDKVIRDVKIITLKSNLVSQFRKEFGLYKVREINDYHHAHDAYLNAVVATAILKKYPKLEPEFVYGDYQKYDIKKYLASKDDSSLGKATAKMFFYSNLMNFFKKKVRLSDGTVLIRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 7 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKAKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 8 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSEQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLATLKQFVRTNLPEKYDEVFSDQSKDGYAGYIDGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENVVHTLTIFEDREMIKQRLAQYDSLFDEKVIKALTRRHYTGWGKLSAKLINGICDKQTGKTILDYLIDDGEINRNFMQLIHDDGLSFKDIIQKAQVVGKTDDVKQVVQELPGSPAIKKGILQSIKIVDELVKVMGHNPENIVVEMARENQFTNQGRRNSQQRYKKIEDAIKNLDSNLNSKILKEYPTNNQALQNDRLFLYYLQNGKDMYTGEELDINQLSNYDIDHIVPQAFIKDDSLDNRVLTSSKDNRGKSDNVPSLEVVQKRKAFWQQLLDSKLISERKFNNLTKAERERGGLNELDKVGFIKRQLVETRQITKHVAQILDARFNTEVNEKGQRIRKVKIITLKSNLVSNFRKEFGLYKVREINDYHHAHDAYLNAVVAKAILKKYPKLEPEFVYGDYQKYDVKRYISRSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 9 - protein, 1373 aa, synthetic construct
MNKPYSIGLDIGTNSVGWAVVDDDYKVPAKKMRVFGDTDRSHIKKNLLGTLLFDSGETAEGRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGQLNAENTDVQKLFADFVGVYDRTFDDSHLSEITVDASSILTEKISKSRRLENLITHYPKEKKNTLFGNLIALALGLQPNFKTNFKLSEDAKLQFSKDTYEEDLEELLGKIGDDYADLFTSAKNLYDAILLSGILTVDDESTKAPLSASMVKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFAWANYHSEEKITPWNFDKVIDKEKSAEKFITRMTSNDLYLPEEKVLPKHSLLYETYTVYNELTKVKYVNEQGNATFFDSNIKQEIFEQLFKTKRKVTKKDIINYLENAYCIDDVEIMGVEDRFNASLGTYHDLLKIIQDKSFLDDKKNEEIIEDVVLTLTLFEDRDMIRQRLQKYSDIFTKQQLKKLERRHYTGWGRLSYKLINGIRNKENNKTILDFLIDDGRANRNFMQLINDDSLSFKTIIQEAQVVGDVDDIETVVHDLPGSPAIKKGILQSIKIVDELVKVMGHNPDNIVIEMARENQTTNRGRSQSQQRLKKLQESLKELGSSILNKEKPSYIEDKVENSHLQNDKLFLYYIQNGKDMYTGEELDIDHLSDYDIDHIIPQAFIKDDSIDNRVLTSSAKNRGKSDDVPSLDIVRDRKAEWIRLYKSKLISKRKFDNLTKAERGGLTENDKAGFIKRQLVETRQITKHVAQILDARFNTERDENDKVIRDVKVITLKSNLVSQFRKEFGFYKVREINDYHHAHDAYLNAVVGTALLKKYPKLAPEFVYGEYQKYDVRKFISTKDNKDIGKATAKYFFYSNLLNFFKEEVRYANGTIIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 10 - protein, 1370 aa, synthetic construct
MKKPYSIGLDIGTNSVGWAVVTDDYKVPAKKMKVLGNTNKESIKKNLIGALLFDAGNTAADRRLKRTARRRYTRRRNRILYLQEIFAEEMNKVDESFFHRLDDSFLVPEDKRGSKYPIFATLEEEKEYHKKFPTIYHLRKHLADSKEKADLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGMRDYQFLDSGQKKKIVSQLFEDKRKVTEKDIIHYLHTIDGYDGIELSGIEKQFNASLSTYHDLLKIIKDKAFLDDSENEAIIEEIIHTLTIFEDREMIKQRLAQYADIFDKSVLKKLARRHYTGWGKLSAKLINGIRDKQSNKTILDYLIDDGKINRNFMQLINDDSLSFKETIQKAQVVGDTDDVKQVVQELPGSPAIKKGILQSIKIVDELVKVMGHNPDNIVIEMARENQTTNRGRSQSQQRLKKLQDSLKELGSNILNEEKPSYIEDKVENSHLQNDQLFLYYIQNGKDMYTGEELDIDHLSDYDIDHIIPQAFIKDDSIDNRVLTSSAKNRGKSDDVPSLDIVRERKADWIRLYKSKLISKRKFDNLTKAERGGLTEADKAGFIKRQLVETRQITKHVAQILDSRFNTKRDENDKVIRDVKVITLKSNLVSQFRKDFELYKVREINDYHHAHDAYLNAVVGTALLKKYPKLAPEFVYGEYKKYDIRKFITSSKDKATAKYFFYSNLMNFFKRIIRYSNGKIVVRPVVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 11 - protein, 1372 aa, synthetic construct
MKKSYSIGLDIGTNSVGWAVVDDDYKVPAKKMRVFGDTDRSHIKKNLLGTLLFDSGETAESRRLKRTARRRYTRRRNRILYLQEIFAEEMAKVDDSFFHRLDESFLTDDDKTFDSHPIFGNKAEEDAYHQKFPTIYHLRKHLADSTEKADLRLVYLALAHMIKFRGHFLIEGQLNAENTDVQTLFNDFVEVYDKTVEESHLAEITVDALSILTEKVSKSRRLENLIKYYPTEKKNTLFGNLVALALGLQPNFKTNFKLSEDAKLQFSKDTYEEDLEELLGKIGDEYADLFTSAKNLYDAILLSGILTVDDNSTKAPLSASMIKRYEEHHEDLEKLKTFVKANNSDKYHEIFSDKDKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFAWANYHSDEPITPWNFDEVVDKEKSAEKFITRMTLNDLYLPEEKVLPKHSHVYETFAVYNELTKIKYVNEQGKSFFFDANMKQEIFDHVFKENRKVTKDKLLDFLNKEFEEFRIVDLIGLDKENKSFNASLGTYHDLKKILDKSFLDDKTNEQIIEDIVLTLTLFEDRDMIRQRLQKYSDIFTKQQLKKLERRHYTGWGRLSYKLINGIRNKENNKTILDFLIDDGRANRNFMQLINDDSLSFKTIIQEAQVVGDVDDIEAVVHDLPGSPAIKKGILQSVKIVDELVKVMGHNPDNIVIEMARENQTTNRGRVQSQQRLKKLQESLKELGSEILNVEKPSYVEGKVENNHLQNDKLFLYYIQNGKDMYTGEELDIDHLSDYDIDHIIPQAFIKDDSIDNRVLTSSAKNRGKSDDVPSLEIVHDRKADWIRLYKSGLISKRKFDNLTKAERGGLTEADKAGFIKRQLVETRQITKHVAQILDARFNTERDENDKVIRDVKVITLKSNLVSQFRKDFKFYKVREINDYHHAHDAYLNAVVGTALLKKYPKLAPEFVYGEYKKYDIRKFITNSSDKATAKYFFYSNLLNFFKTKVRYADGTILVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 12 - protein, 1374 aa, synthetic construct
MKKPYSIGLDIGTNSVGWAVVDDDYKVPAKKMRVFGDTDRSHIKKNLLGTLLFDDGNTAESRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISLYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHEEDLAALKQFVKANLPEKYDEVFSDQSKDGYAGYIDGKTTQEAFYKYIKNLLSKLEGADYFLDKIEREDFLRKQRTFDNGSIPHQIHLQEMNAILRRQGEHYPFLKDNKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKTKRKVTEKDIINYLHKVDGYDGVEISGVEDRFNASLGTYHDLLKIIKDKSFLDDKKNEEIIEDIVLTLTLFEDRDMIRQRLQKYSDIFTPQQLKKLERRHYTGWGRLSYKLINGIRNKENNKSILDYLIDDGYANRNFMQLINDDTLPFKQIIQKSQVVGDIDDIKTVVHDLPGSPAIKKGILQSVKIVDELVKVMGHNPDNIVIEMARENQTTNRGRSQSQQRLKKLQESLKELGSNILNVEKPSYIEDKVENNHLQNDKLFLYYIQNGKDMYTGEELDIDHLSDYDIDHIIPQAFIKDDSIDNRVLTSSAKNRGKSDDVPSLDIVRGRKAEWIRLYKAKLISQRKFDNLTKAERGGLTENDKAGFIKRQLVETRQITKHVAQILDARFNTKRDENDKLIREVKVITLKSNLVSQFRKEFGFYKVREINDYHHAHDAYLNAVVGTAILKKYPKLTSEFVYGEYKKYDIRKFIKSDDHSEMGKATAKYFFYSNLLNFFKEEIKYANGKIVVRPVVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 13 - protein, 1366 aa, synthetic construct
MKKPYSIGLDIGTNSVGWTVITDDYKVPAKKMKVLGNTDKSHMKKNLLGALLFDSGNTAENRRLKRTARRRYTRRRNRILYLQEIFAEEMGKVDDSFFHRLEDSFLVVEDKRGERHPIFGNLEEEVKYHENFPTIYHLRQYLADNPAKADLRLVYLALAHIIKFRGHFLIEGSFDTRNNDVQRLFSEFLSVYDNVFEGSSLSEQNAQVEAILTDKISKSAKRERVLKLFPDEKSTGLFAEFLKLIVGNQADFKKHFDLEEKAPLQFSKDTYDEDLENLLGQIGDDFADLFLVAKKLYDAILLSGILTVTDPSTKAPLSASMIERYESHQKDLAALKQFIQNNLSDKYDEVFSDQSKDGYAGYIDGKTTQEAFYKYVKKLIEKIEGTDYFLDKIKREDLLRKQRTFDNGSIPHQIHLGELRAILRRQGDFYPFLKDNQERIEKILTFRIPYYVGPLARGNNDFAWLTRNSDQAIRPWNFEEVVDKARSAEDFIHRMTSFDLYLPEEKVLPKHSLLYETFTVYNELTKVKFIAEGLRDYQFLDRGQKKEIVNQLFKEKRKVTKKDIEHYLHTIDGYDGIELKGIEKQFNSSLSTYHDLLKIIKDKEFLDDASNEAILEEIVHTLTIFEDREMIKQRLAQYSAIFDDKVIKALSRRHYTGWGRLSAKLINGIRDEKSGKTILDYLIDDGLANRNFMQLIHDDSLTFVEEIQKAQVSGQGHSLHEQIANLAGSPAIKKGILQTVKIVDELVKIMGHNPTNIVIEMARENQTTNQGRRNSQQRLKGIEEGMKELGSQILKEHPVENSQLQNEKLYLYYLQNGRDMYTGQELDINRLSDYDIDHIVPQSFIKDDSIDNRVLTLSNENRGKSDDVPSEEVVKKMKNYWRQLLNVKLITQRKFDNLTKAERGGLSELDKAGFIKRQLVETRQITKHVAQILDSRMNAKYDENDKLIRDVKIITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPVIEANEETGEIVWDKGRDFTMVRKVLCMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 14 - protein, 1370 aa, synthetic construct
MDKKYSIGLDIGTNSVGWAVITDDYKVPAKKMKVLGNTDKHTIKKNLLGALLFDSGETAEATRLKRTARRRYTRRKNRIRYLQEIFSEEMGKVDDSFFHRLEDSFYVEEDKKHDRHPIFANLVEEVAYHKNFPTIYHLRKKLVDNPDKVDLRLIYLALAHIVKFRGHFLIEGDFDIKNNDIQKIFNEFLQIYNSIFESNSLQKGNVQVEEILTDKISKSAKRERVLKLFPDEKSTGLFAEFLKLIVGNQADFKKHFDLEEKAPLQFSKDTYDEDLENLLGQIGDDFADLFLVAKKLYDAILLAGILSVDAPGTKAPLSASMIQRFDEHQEDLVRLKAFIRRSLPETYNEVFKDDTKNGYAGYIDGKTNQEDFYAYLKKLLTGLEGADYFLEKINREDLLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVKFIAEGLRDYQFLDAEQKKEIVTLLFKEKRKVTVKDIEHYLHAIDGYDGIELKGIEKQFNSSLSTYHDLLKIIKDKEFMDDAKNEAILENIVHTLTIFEDREMIKQRLAQYASIFDEKVIKALTRRHYTGWGKLSAKLINGIHDKKSGKTILDYLIDDGYTNRNFMQLIHDDGLSFKEIIQKAQVVGKTDNVKQVVQELPGSPAIKKGILQSIKIVDELVKVMGHAPESIVIEMARENQTTARGKKNSQQRYKRIEDSLKNLASGLDSQILKEHPTDNIQLQNDRLFLYYLQNGRDMYVGQELDINRLSDYDVDHIIPQAFIKDDSIDNRVLTSSKDNRGKSDNVPSEDVVKKMKNYWRQLLNAKLITQRKFDNLTKAERGGLSELDKAGFIKRQLVETRQITKHVAQILDSRMNAKYDENDKLIRDVKIITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLCMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 15 - protein, 1363 aa, synthetic construct
MTKPYSIGLDIGTNSVGWSVITDDYKVPAKKMKVLGNTDKQTIKKNLLGALLFDSGNTAEATRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGELKSENKDVQHLFNDFVEMFDKTVEGSYLSENLPNVADVLVEKISKSRRLENILQYFPNEKKNGLFGNFLALALGLTPNFKSNFDLAEDAKLQLSKDSYDEDLESLLAQIGDDYSDVFLKAKKLYDAILLSGILTVTDNETEAPLSSAMIMRYKEHEEDLALLKAYIRNISLDTYNEVFKDDTKNGYAGYIDGKTNQEDFYVYLKKLLAKLEGADYFLEKINREDLLRKQRTFDNGSIPYQIHLGEMRAILDKQAKFYPFLAENQDRIEKILTFRIPYYVGPLARGNSDFAWSIRKRDEKITPWNFEDVIDKESSAEAFINRMTSFDLYLPEEKVLPKHSLLYETFTVYNELTKVKFIAEGLRDYQFLDSEQKKQIVNQLFKEKRKVTEKDIEHYLHTVDGYDGIELKGIEKQFNSSLSTYHDLLKIIKDKEFMDDAKNEAILENIVHTLTIFEDREMIKQRLAQYDSIFDEKVIKALTRRHYTGWGKLSAKLINGICDKQTGKTILDYLIDDGEMNRNFMQLINDDGLSFKEIIQKAQVVGKTDNVKQVVQELPGSPAIKKGILQSIKIVDELVKVMGHAPESIVIEMARENQTTARGKKNSQQRYKRIEDSLKNLASGLDSNILKENPTDNIQLQNDRLFLYYLQNGRDMYTGKPLDINQLSSYDIDHIVPQAFIKDDSIDNRVLTSSKDNRGKSDNVPSEEVVKKMKAFWRQLLDAKLISQRKFDNLTKAERGGLTNDDKARFIQRQLVETRQITKHVARILDERFNTETDENNQKIRTVKIVTLKSNLVSNFRKEYQLYKVREINNYHHAHDAYLNAVVAKAILTKYPQLEPEFVYGDYPKYNSYKTRKSATEKLFFYSNIMNFFKTEILLANGEIRKRPQIETNDETGEIVWNKCRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 16 - protein, 1370 aa, synthetic construct
MKKPYSIGLDIGTNSVGWAVITDSYKVPSKKMKVLGNTSKKYVKKNLLGALLFESGITAEGRRLKRTARRRYTRRRNRILYLQEIFAEEMNKIDESFFHRLDDSFLVPEDKRGSKYPIFATLEEEKEYHKQFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYINGKTTQEAFYKYIKNLLNKVEGADYFLDKIEREDFLRKQRTFDNGSIPHQIHLQEMHAILQRQGEHYPFLKDNKEKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLATYHDLLKIIKDKEFMDDPKNEEILEKIIHTLTLFEDREMIKQRLEQYADIFDKSVLKKLSRRHYTGWGKLSAKLINGIRDKKTGKTILDYLIDDGYSNRNFMQLINDDSLSFKEKIKEAQRSGEGDDLREEVQNLAGSPAIKKGILQSLKIVDELIEVMGRDPEHIVVEMARENQFTNQGRRNSQQRYKKLKNAIKNLDNNLNSKILKEYPTNNQALQNDRLFLYYIQNGKDMYTGEELDIDNLSQYDIDHIIPQAFIKDDSIDNRVLTSSAKNRGKSDDVPSIEIVKDRRNFWKQLLDSQLISQRKFDNLTKAERGGLTEADKAGFIKRQLVETRQITKHVAQILDARFNTKRDENDKVIRDVKVITLKSNLVSQFRKDFQFYKVREINDYHHAHDAYLNAVVGTALIKKYPKLESEFVYGDYKVYDVRRMIAKSEQEIGKATAKRFFYSNILNFFKTEIKLANGEIRKRPLIETNEETGEIVWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 17 - protein, 1372 aa, synthetic construct
MKKPYSIGLDIGTNSVGWAVITDDYKVPAKKMKVLGNTNKETIKKNLLGALLFDSGETAEATRLKRTARRRYTRRKNRLRYLQEIFSEEMAKVDDSFFHRLEESFLKDDDKQFDKHPIFGNKAEEKAYHKKFPTIYHLRKHLADSKEKADLRLVYLALAHMIKFRGHFLIEGELKAENTDIQALFKDFVEVYDKTIDESHISEIEVDAISILTEKISKSRRLEKLIQHYSLEKKNTLFGNLIALSLGLQPNFKTNFQLSEDAKLQFSKDTYEEDLEGLLGQVGDEYADLFASAKNLYDAILLSGILTVDDNSTKAPLSASMIKRYKEHKEDLALFKQFIKSNIPEKYNHIFALGEDEKYNGYTGGNDKKLGHRSGKLVTEEEFYKYLKNILNKVEGADYFLDKIDREDFLRKQRTFDNGSIPHQIHLQEMHAILHRQGEHYPFLKENQDKIEKILTFRIPYYVGPLARKGSRFAWAEYKTDEKITPWNFEDIIDKEKSAEKFITRMTLNDLYLPEEKVLPKHSLLYEEFAVYNELTKVRYVTEQGKSFFFDANMKQEIFDGVFKVYRKVTKEKLLDFLDNEFDEFRIVDLTGLDKENKAFNASLGTYHDLKKIIDKDLLDNSSNKTILEDLVLTLTLFEDKKMIKKCLQKYDNLFDDKVLKKLKRRHYTGWGRLSAKLINGIRDKKSGKTILDFLTDDGYVNRNFIQLINDGRLTFKKAIEKAQVSGQGDSLTEEVQSLAGSPAIKKGILQSLKIVDELIKVMGYKPENIVIEMARENQTTNQGRRKSQQRLKGLIDSIKEFGSNILKEHPTDNSALQNDRLYLYYLQNGKDMYTGDELDIDQLSNYDIDHIIPQAFLKDNSIDNKVLVSSASNRGKSDDVPSLEVVKKRKTFWHQLLKSKLISQRKFDNLTKAERGGLSPEDKAGFIQRQLVETRQITKHVARLLDERFNNKKDEDNKTLRTVKIITLKSSLVSQFRKDFQLYKVREINDFHHAHDAYLNAVVASALLKKYPKLEPEFVYGDYPKYNSYKTRKSATEKLFFYSNIMNFFKTEITLANGEIRKRPLIETNEETGEIVWNKCRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 18 - protein, 1376 aa, synthetic construct
MKKPYSIGLDIGTNSVGWAVVTDDYKVPAKKMKVLGNTDKSHIKKNLLGALLFDSGNTAEDRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEEIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLSEKYDEVFSDQSKDGYAGYIEGKTTQEAFYKYIKKAIEKIEGSDYFLDKIERENFLRKQRTFDNGSIPHQIHLQEMHAIIHRQGEYYPFLKENKEKIEKILTFRIPYYVGPLARGKSDFAWLTRKSDDAIRPWNFEEMVDKESSAEAFIHRMTNYDLYLPEEKVLPKHSLLYEKFAVYNELTKVRYVTEQGKSFFFDANMKQEIFDGIFKKYRKVTKEKLMDFLGKEFDEFRIVDLMGLDKDNKSFNASLGTYHDLKKIVSKDFLDNPENEDILENVVLTLTLFEDREMIRKRLEKYKDVLTEEQRKKLERRHYTGWGRLSAKLINGIRDKVTRKTILDYLIDDGTSNRNFMQLIHDDTLSFVDEIRLAQGSGEAEDYREEVQNLAGSPAIKKGILQSLKIVDELVGVMGYDPEHIVVEMARENQFTNQGRRNSQQRYKKIKDAIKNLDSNLNSKILKEYPTDNQALQNDRLFLYYLQNGKDMYTGEALDINQLSNYDIDHIIPQAFIKDDSLDNRVLTSSKDNRGKSDNVPSIEVVEKMKAFWQQLLDSKLISERKYNNLTKAERERGGLNELDKVGFIKRQLVETRQITKHVAQILDARFNTEVDEKGKRIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 19 - protein, 1352 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATVRKVLSCPQVNIVKKTEVQTGGFSKESILPKGNSDKLIPRKTKKFYWDTKKYGGFDSPIVAYSVLVIADIEKGKAKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 20 - protein, 1369 aa, synthetic construct
MGKPYSIGLDIGTNSVGWAVITDDYKVPAKKMKVLGNTDKKYIKKNLLGALLFDSGETAEATRLKRTARRRYTRRKNRLRYLQEIFAEEMAKVDSTFFRRLNESFLTDDDKQFNACPIFGNLAEEDAYHEKFPTIYHLRKYLADNPDKADLRLIYLALAHMIKFRGHFLIEGELNSENTDIQKVFEEFVEIFERDVKSELSESKLEIASVLLEKTAKARRLESVLAQFPNEKRTGLFAEFLKLIVGNQADFKKHFDLEEKAPLQFSKDTYDEDLENLLGQIGDGFAELFLVAKKLYDAILLSGILTVTDPSTKAPLSASMIERYESHQKDLAALKQFVRRNLPEKYDEVFSDQSKDGYAGYIDGKTTQEAFYKYIKKLIEKIDGKGYFLAKIKQEDLLRKQRTFDNGSIPHQIHLGELHAIIRRQEDFYPFLKENRKKIEKLLTFRIPYYVGPLARGNNDFAWLTRNSDQAIRPWNFEEIVDKASSAEDFIHKMTNYDLYLPEEKVLPKHSLLYETFTVYNELTKVKFIAEGLRDYQFLDSGQKKQIVNQLFKEKRKVTEKDIIHYLHTVDGYDGIELKGIEKQFNSSLSTYHDLLKIIKDKEFMDDAKNEVILENIVHTLTIFEDREMIKQRLAQYSSIFDEKVIKALTRRHYTGWGKLSAKLINGICDKKTGKTILDYLIDDGYTNRNFMQLINDDSLSFKEIIEKAQVSGKGDSVHEQIANLAGSPAIKKGILQSIKIVDELVKVMGHKPENIVIEMARENQTTAKGKKNSQQRYKRIEEGLENLAKELGSQILKEHPADNIQLQNDRLYLYYLQNGKDMYTGEALDINRLSDYDIDHIVPQAFIKDNSIDNKVLTYSKENRGKSDNVPSEDVVKKMKNYWRQLLNAKLITQRKFDNLTKAERGGLSELDKAGFIKRQLVETRQITKHVAQILDSRMNAKYDENDKLIRDVKIITLKSKLVSDFRKDFQFYKVREINNYHHAHDAYLNAVVGTALIKKYPKLESEFVYGDYKVYDVRKMIAKSEQEIGKATAKQFFYSNIMNFFKTEITLANGEIRKRPVIETNEETGEIVWDKGRDFATVRKVLCMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 21 - protein, 1379 aa, synthetic construct
MKKSYSIGLDIGTNSVGWSVVTDDYKVPAKKMKVFGNTDKKYIKKNLLGALLFDSGETAEGTRLKRTARRRYTRRRNRILYLQEIFAKEMAKVDESFFQRLEESFLTDDDKNFDSHPIFGNKAEEDAYHEQFPTIYHLRKHLADSSEKADLRLVYLALAHMIKFRGHFLIEGQLKAENTNVQTLFNDFVEVYDKTVEESHLAEITVDALSILTEKVSKSRRLENLLKYYPTEKKNTLFGNLIALSLGLQPNFKTNFKLSEDAKLQFSKDTYEEDLEELLGKIGDEYADLFTSAKNLYDAILLSGILTVDDKSTKAPLSASMLKRYVEHHEDLEKLKDFVKANKPELYHDIFKDETKNGYAGYIENGVKQDEFYKYLKNTLSKIAGSDYFLDKIEREDFLRKQRTFDNGSIPHQVHLQEMRAILRRQGEYYPFLKENQAKIEKILTFRIPYYVGPLARKDSRFAWAEYHSDEKITPWNFDKVIDKESSARAFIEHMTNNDLYLPEEKVLPKHSPLYEKYTVYNELTKVKYVTEQGKSSFFDANMKQEIFEHVFKKNRKVTKDKFLNYLNKEFPEYRIHDLIGLDKENKSFNASLGTYHDLKKILDKSFLDNKENEEIIEDVVLTLTLFEDRDMIRQRLQKYSDIFTKDQLKKLERRHYTGWGRLSYKLINGIRDKQSNKTILDYLLEDDGVKKNINRNFMQLINDDSLSFKTIIQEAQVIGDIDDIKAVVHDLPGSPAIKKGILQSVKIVDELVKVMGHNPDNIVIEMARENQTTNRGRSQSQQRLKKLQESLKELGSNILNEEKPSYIEDKVENSHLQNDRLFLYYIQNGKDMYTGDELDIDHLSDYDIDHIIPQAFIKDNSIDNRVLTSSAKNRGKSDDVPSLDIVRERKADWIRLYKAGLISKRKFDNLTKAERGGLTENDKAGFIKRQLVETRQITKHVAQILDARFNTKRDENDKVIRDVKIITLKSNLVSQFRKEFGFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEVVWNKERDFAIVRKVLSCPQVNIVKKTEVQTGGFSKESILPKGNSDKLIARKKDWDPKKYGGFDSPIVAYSVLVVAKVAKGKSQKIKTIKELVGIKIMEQDEFEKDPIAFLEKKGYQDIQKDLIIKLPKYSLFELENGRKRLLASAGELQKGNELALPSKYVNFLYLASHYEKLKGSPEDNEQKQLFVEQHQHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 22 - protein, 1383 aa, synthetic construct
MKKSYSIGLDIGTNSVGWSVVTDDYKVPAKKMKVFGNTDKKYIKKNLLGALLFDSGETAEGTRLKRTARRRYTRRRNRILYLQEIFAKEMAKVDESFFQRLEESFLTDDDKNFDSHPIFGNKAEEDAYHEQFPTIYHLRKHLADSSEKADLRLVYLALAHMIKFRGHFLIEGQLKAENTNVQTLFNDFVEVYDKTVEESHLAEITVDALSILTEKVSKSRRLENLLKYYPTEKKNTLFGNLIALSLGLQPNFKTNFKLSEDAKLQFSKDTYEEDLEELLGKIGDEYADLFTSAKNLYDAILLSGILTVDDKSTKAPLSASMLKRYVEHHEDLEKLKDFVKANKPELYHDIFKDETKNGYAGYIENGVKQDEFYKYLKNTLSKIAGSDYFLDKIEREDFLRKQRTFDNGSIPHQVHLQEMRAILRRQGEYYPFLKENQAKIEKILTFRIPYYVGPLARKDSRFAWAEYHSDEKITPWNFDKVIDKESSARAFIEHMTNNDLYLPEEKVLPKHSPLYEKYTVYNELTKVKYVTEQGKSSFFDANMKQEIFEHVFKKNRKVTKDKFLNYLNKEFPEYRIHDLIGLDKENKSFNASLGTYHDLKKILDKSFLDNKENEEIIEDVVLTLTLFEDRDMIRQRLQKYSDIFTKDQLKKLERRHYTGWGRLSYKLINGIRDKQSNKTILDYLLEDDGVKKNINRNFMQLINDDSLSFKTIIQEAQVIGDIDDIKAVVHDLPGSPAIKKGILQSVKIVDELVKVMGHNPDNIVIEMARENQTTNRGRSQSQQRLKKLQESLKELGSNILNEEKPSYIEDKVENSHLQNDRLFLYYIQNGKDMYTGDELDIDHLSDYDIDHIIPQAFIKDNSIDNRVLTSSAKNRGKSDDVPSLDIVRERKADWIRLYKAGLISKRKFDNLTKAERGGLTENDKAGFIKRQLVETRQITKHVAQILDARFNTKRDENDKVIRDVKIITLKSNLVSQFRKEFGFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEVVWNKERDFAIVRKVLSCPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 23 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFAAEMNKIDESFFQRLDDSFLVPDDKRDSKYPIFGNLAEEKAYHEKFPTIYHLRKYLADSSEKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQAEFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNILSKLEGSDYFLDKIEREDFLRKQRTFDNGSIPHQIHLQEMNAILRRQGEHYPFLKENKEKIQQILTFRIPYYVGPLARGNRDFAWLTRNSDQAIRPWNFEEIVDQASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALARRHYTGWGRLSAKLIDGIYDKQSRKTILDYLIDDGEINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTDEELDINQLSNYDIDHIIPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVDENNQRIRKVKIVTLKSNLVSNFRKEFGLYKVREINDYHHAHDAYLNAVVAKAILKKYPKLEPEFVYGDYQKYDVKRYISRSKDPKEIEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 24 - protein, 1370 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKVYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAILRRQGEHYPFLKENKEKIQQILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDAKNEEILENIVHTLTIFEDREMIKQRLAQYDSLFDEKVIKALARRHYTGWGKLSAKLINGIRDKQSQKTILDYLIDDGEINRNFMQLIHDDGLSFKDIIQKAQVVGDTDDLKQVVQNLPGSPAIKKGILQSIKIVDELVKVMGGDPESIVVEMARENQFTNQGKRNSQQRYKRIEDAIKNLDSNLNSKILKEYPTDNQALQNDRLFLYYLQNGKDMYTGEALDINQLSNYDIDHIIPQAFIKDDSLDNRVLTSSKDNRGKSDNVPSIEVVKARKAFWQQLLDSKLISERKFNNLTKAERGGLNELDKVGFIKRQLVETRQITKHVAQILDARFNTEVNEENQKIRTVKIITLKSNLVSNFRKEFGLYKVREINDYHHAHDAYLNAVVAKAILKKYPKLEPEFVYGDYKRYDLQKLRAKSEKEMGKATAKKFFYSNLMNFFKKEVRLADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 25 - protein, 1372 aa, synthetic construct
MTKPYSIGLDIGTNSVGWAVITDNYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKAYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLEKIEREDFLRKQRTFDNGSIPHQIHLQEMNAILHNQGEYYPFLKENSEKIQQILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIIHTLTIFEDREMIKQRLAQYDSIFDEKVIKALTRRHYTGWGKLSAKLINGIRDKKSGKTILDYLIDDDKINRNFMQLIHDDGLSFKEIIQKAQVVGKTDDVKQVVQELPGSPAIKKGILQSIKIVDELVKVMGHAPESIVIEMARENQTTNQGKRNSQQRYKRIEEAIKNLAPELDGNILKEYPTDNQALQNDRLFLYYLQNGKDMYTGEELDINQLSNYDIDHIVPQAFIKDDSIDNRVLTSSKDNRGKSDNVPSLEVVQKRKAFWQQLLDSKLISERKFNNLTKAERGGLDERDKVGFIRRQLVETRQITKHVAQILDARFNTEVNEKNQKIRSVKIITLKSNLVSNFRKEFELYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 26 - protein, 1372 aa, synthetic construct
MTKPYSIGLDIGTNSVGWAVITDDYKVPSKKMKVLGNTSKKYVKKNLLGALLFESGITAEGRRLKRTARRRYTRRRNRILYLQEIFSTEMNKIDESFFQRLDDSFLVPDDKRDSKYPIFGNLAQEKTYHDEFPTIYHLRKYLADSSKKADLRLVYLALAHMIKYRGHFLIEGDFNSKSNSIKETFSKFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLATLKQFIKNNLSEKYDEVFSDQSKDGYAGYIDGKTTQEAFYKYIKNLLSKLEGADYFLDKIEREDFLRKQRTFDNGSIPHQIHLQEMNAILRRQGEHYPFLKENREKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTDDVKQVVQNLPGSPAIKKGILQSIKIVDELVKVMGKDPESIVIEMARENQTTNQGRRNSQQRYKKIEEAIKKLDIDLNSKILKEYPTNNQALQNERLFLYYLQNGKDMYTDQELDINRLSDYDIDHIVPQAFIKDDSLDNRVLTSSKDNRGKSDNVPSEEVVQKMKGFWQQLLKSKLISKRKFDNLTKAERGGLTEKDKAGFIKRQLVETRQITKHVAQILDARFNTEVNEKNQKIRKVKIVTLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 27 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMSKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLAALKQFIKTNLPEKYDEVFSDQSKDGYAGYIDGKTTQEAFYKYIKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNQEILENIVHTLTIFEDREMIKQRLAQYDSIFDEKVIKALTRRHYTGWGKLSAKLINGICDKKTGKTILDYLIDDGEINRNFMQLIHDDGLSFKEIIQKAQVFGKTDDVKQVVQELPGSPAIKKGILQSIKIVDELVKVMGHAPESIVIEMARENQTTNQGRRNSQQRYKKIKEAIKNLDSNLNSKILKEYPTDNQALQNDRLFLYYLQNGKDMYTGEPLDINQLSSYDIDHIIPQAFIKDDSLDNRVLTSSKDNRGKSDNVPSLEIVEKMKGFWQQLLNSKLISERKFNNLTKAERGGLDERDKVGFIKRQLVETRQITKHVAQILDARFNTEVNDKNQKIRTVKIITLKSNLVSNFRKEFGLYKVREINDYHHAHDAYLNAVVAKAILKKYPKLEPEFVYGDYQKYDLKRYISKSKNPKELDKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 28 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFDTEMKEIDESFFQRLDDSFLVPDDKRDSKYPIFGNLAQEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLSEKYDEVFSDESKDGYAGYINGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSQKTILDYLIDDDKINRNFMQLINDDGLSFKEIIQKAQVVGKTDDVKQVVQELPGSPAIKKGILQSIKIVDELVKVMGHAPESIVIEMARENQTTARGRKNSQQRYKKIMDAIKNLDSNLNSKILKEYPTDNQALQNDRLFLYYLQNGKDMYTGEPLDINQLSSYDIDHIIPQAFIKDDSLDNRVLTSSKDNRGKSDNVPSIEVVKKMKGFWQQLLDSKLISERKFNNLTKAERGGLDERDKVGFIRRQLVETRQITKHVAQILDARFNTEVDEKGKRIRKVKIITLKSNLVSNFRKEFGLYKVREINDYHHAHDAYLNAVVAKAILKKYPKLEPEFVYGDYQKYDVKRYISRSKDPKEVEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 29 - protein, 1374 aa, synthetic construct
MKKPYSIGLDIGTNSVGWAVVDDDYKVPAKKMRVFGDTDRSHIKKNLLGTLLFDDGNTAESRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISLYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHEEDLAALKQFVKANLPEKYDEVFSDQSKDGYAGYIDGKTTQEAFYKYIKNLLSKLEGADYFLDKIEREDFLRKQRTFDNGSIPHQIHLQEMNAILRRQGEHYPFLKDNKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKTKRKVTEKDIINYLHKVDGYDGVEISGVEDRFNASLGTYHDLLKIIKDKSFLDDKKNEEIIEDIVLTLTLFEDRDMIRQRLQKYSDIFTPQQLKKLERRHYTGWGRLSYKLINGIRNKENNKSILDYLIDDGYANRNFMQLINDDTLPFKQIIQKSQVVGDIDDIKTVVHDLPGSPAIKKGILQSVKIVDELVKVMGHNPDNIVIEMARENQTTNRGRSQSQQRLKKLQESLKELGSNILNVEKPSYIEDKVENNHLQNDKLFLYYIQNGKDMYTGEELDIDHLSDYDIDHIIPQAFIKDDSIDNRVLTSSAKNRGKSDDVPSLDIVRGRKAEWIRLYKAKLISQRKFDNLTKAERGGLTENDKAGFIKRQLVETRQITKHVAQILDARFNTKRDENDKLIREVKVITLKSNLVSQFRKEFGFYKVREINDYHHAHDAYLNAVVGTAILKKYPKLTSEFVYGEYKKYDIRKFIKSDDHSEMGKATAKYFFYSNLLNFFKEEIKYANGKIVVRPVVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 30 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQNFLDSYNAIFESDLSLENSEQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLATLKQFVKANLPEKYDEVFSDQSKDGYAGYIDGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDQASSAEEFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSQKTILDYLIDDDKINRNFMQLIHDDGLSFKEIIQKAQVFGKTDDVKQVVQELPGSPAIKKGILQSIKIVDELVKVMGHAPESIVIEMARENQTTARGRKNSQQRYKKIMDAIKNLDSNLNSKILKEYPTDNQALQNDRLFLYYLQNGKDMYTGEPLDINQLSSYDIDHIIPQAFIKDDSLDNRVLTSSKDNRGKSDNVPSLEIVEKMKGFWQQLLDSKLISERKFNNLTKAERGGLDERDKVGFIKRQLVETRQITKHVAQILDARFNTEVNEKKQKIRTVKIITLKSNLVSNFRKEFRLYKVREINDYHHAHDAYLNAVVAKAILKKYPKLEPEFVYGDYQKYDLKRYISKSKNPKSIDKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 31 - protein, 1372 aa, synthetic construct
MTKPYSIGLDIGTNSVGWAVITDNYKVPSKKMKVLGNTSKKYVKKNLLGALLFESGITAEGRRLKRTARRRYTRRRNRILYLQEIFSTEMSKVDESFFQRLDDSFLVPDDKRDSKYPIFGNLVEEKTYHDEFPTIYHLRKYLADSTKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYINGKTTQEAFYKYIKNLLSKLKGADYFLEKIEREDFLRKQRTFDNGSIPHQIHLQEMNAILRRQGEHYPFLKENREKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDILKIIKDKEFMDDPKNGEILENIIHTLTIFEDREMIKQRLAQYDSIFDEKVIKALARRHYTGWGKLSAKLINGIRDKQTNKTILDYLIDDDKINRNFMQLINDDGLSFKDIIQKAQVVGKTDDVKQVVQELPGSPAIKKGILQSIKIVDELVKVMGHAPESIVIEMARENQTTNQGKRNSQQRYKRIEEAIKNLDSNLNSKILKEYPTDNQALQNDRLFLYYLQNGKDMYTGEELDINQLSNYDIDHIIPQAFIKDDSLDNRVLTSSKDNRGKSDNVPSLEVVQKRKGFWQQLLNSKLISERKFNNLTKAERGGLDERDKVGFIKRQLVETRQITKHVAQILDARFNTEVDENGKRIRKVKIITLKSNLVSNFRKEFGLYKVREINDYHHAHDAYLNAVVAKAILKKYPKLEPEFVYGDYQKYDIKRYISKSRNPRSVDKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 32 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQNFLDSYNAIFESDLSLENSEQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLEKIEREDFLRKQRTFDNGSIPHQVHLQEMNAILHRQGEYYPFLQENKEKIQQILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLINDDGLSFKEIIQKAQVVGKTDDVKQVVQELPGSPAIKKGILQSIKIVDELVKVMGHAPESIVIEMARENQTTNQGKRNSQQRYKRIEDAVKNLASELDGNILKEYPTDNQALQNDRLFLYYLQNGKDMYTGEPLDINQLSSYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVNEKGQKIRKVKIITLKSNLVSNFRKEFGLYKVREINDYHHAHDAYLNAVVAKAILKKYPKLEPEFVYGDYQKYDIKRYISRSKDPKDVEKATQKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 33 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKSNLSEKYDEVFSDESKNGYAGYIENGVKQDEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEEFINKMTNYDLYLPEEKVLPKHSLLYETFAVYNELTKVKFIAEGLRDYQFLDSGQKKQIVNQLFKEKRKVTEKDIIHFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKKTGKTILDYLIDDGEINRNFMQLIHDDGLSFKEIIQNAQTFGKTDDVKQVVQELPGSPAIKKGILQSIKIVDELVKVMGHAPESIVIEMARENQTTARGKKNSQQRYKRIEDSLKNLASGLDSNILKENPTDNIQLQNDRLFLYYLQNGKDMYTGEALDINQLSSYDIDHIIPQAFIKDDSLDNRVLTSSKDNRGKSDNVPSEEVVEKMKAFWQQLLDSKLISERKYNNLTKAERERDGLNELDKVGFIKRQLVETRQITKHVAQILDARFNTEVNEKKQKIRSVKIITLKSNLVSNFRKEFGLYKVREINDYHHAHDAYLNAVLAKAILKKYPKLEPEFVYGDYQKYDLKRYISKSKEPKDIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 34 - protein, 1376 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMNKIDESFFQRLDDSFLVPDDKRDSKYPIFGNLVEEKAYHDEFPTIYHLRKYLADSQKKADLRLVYLALAHMIKYRGHFLIEGDFNSRNNDIKKNFQDFLDSYNAIFESDLSLENSKQLEEIVKDKISKSAKKDRILKLFPGEKNSGIFSEFLKLIVGNQADFKKYFNLDEKAPLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTELKGADYFLDKINREDLLRKQRTFDNGSIPYQIHLQEMHAILRKQEKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGKTILDYLIDDGISNRNFMQLIHDDTLSFKKKIQKAQIIGDQDNIKQVVQSLPGSPAIKKGILQSIKIVDELVKVMGRNPESIVVEMARENQYTNQGKSNSQQRLKRLEESLKELGSKILKENVPVKLSKIDNNALQNERLYLYYLQNGKDMYTGQDLDIDRLSNYDIDHIIPQAFLKDNSIDNKVLVSSASNRGKSDDVPSLDVVKKRKGFWHQLLKSKLISQRKFDNLTKAERGGLTEADKAGFIQRQLVETRQITKHVAQILDERFNNEVTDKGKKIRKVKIITLKSNLVSQFRKEFGFYKVREINDYHHAHDAYLNAVVATALLKKYPQLAPEFVYGDYKQVKIDKNGKRTKSQIETSSDKATAKYFFYSNLLNFFKTKVRYADGTVLVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 35 - protein, 1372 aa, synthetic construct
MTKPYSIGLDIGTNSVGWAVITDNYKVPSKKMKVLGNTSKKYVKKNLLGALLFESGITAEGRRLKRTARRRYTRRRNRILYLQEIFATEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHFLHNVDGYDGIELKGIEKQFNASLSTYHDLLKIIKDKEFMDDPKNEEILENIVHTLTIFEDREMIKQRLNQYDSLFDEKVIKALTRRHYTGWGKLSAKLINGIRDKQTGKTILDYLIDDGYSNRNFMQLINDDGLSFKEIIQKAQVVGESDNLKQVVQNLPGSPAIKKGILQSIKIVDELVKVMGHDPEQIVIEMARENQTTNQGRRNSQQRYKKIENAIKNLDSNLNSKILKEYPTDNKALQNERLFLYYLQNGRDMYRDEELDINQLSNYDIDHIVPQAFIKDDSLDNRVLTSSKDNRGKSDNVPNIEIVEKMKGFWRQLLKSKLISQRKFDNLTKAERGGLTEHDKAGFIKRQLVETRQITKHVAQILDARFNTEVNEKNQKIRTVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIVKRENVEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 36 - protein, 1372 aa, synthetic construct
MKKPYSIGLDIGTNSVGWAVVTDDYKVPAKKMKVLGNTDKSHIKKNLLGALLFEGGETAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGEFNSRNNDIKKNFQEFLDSYNAIFESDLSLSHSEQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLSEKYDEVFSDQSKDGYAGYIDGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDFLIDDDKINRNFMQLINDDGLSFKEIIQKAQVVGKTDDLKQVVQELPGSPAIKKGILQSIKIVDELVKVMGHDPESIVIEMARENQTTNQGRRNSQQRYKKIEEAIKNLDSNLNSKILKEYPTNNQALQNDRLFLYYLQNGKDMYTGEPLDINQLSNYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVNDKKQKIRNVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 37 - protein, 1371 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSTKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIEYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGKTILDYLIDDGVSNRNFMQLIHDDTLSFKKKIQKAQIIGDQDNIKQVVQSLPGSPAIKKGILQSIKIVDELVKVMGRNPEHIVVEMARENQFTNQGRRNSQQRLKRLEESLKELGSKILKENVPAKLSKIDNNALQNDRLYLYYLQNGKDMYTGEELDIDRLSDYDIDHIIPQAFLKDDSIDNRVLVSSASNRGKSDDVPSLEVVKRRKNFWRQLLKSKLISQRKFDNLTKAERGGLTEKDKAGFIHRQLVETRQITKHVAQLLDSRFNTKRDDAGKVIREVKIITLKSSLVSQFRKDFKLYKVREINDYHHAHDAYLNAVVATAILKKYPKLEPEFVYGNYRDYQKYLMIKSDKDYGKATAKMFFYSNLMNFFKKEVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 38 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLSEKYDEVFSDQSKDGYAGYIDGKTTQEAFYKYIKNLLTKFEGADYFLEKIKREDFLRKQRTFDNGSIPYQVHLQEMKAILSRQGDYYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDAKNEEILENIIHTLTIFEDREMIKQRLAQYDSLFDEKVIKALTRRHYTGWGKLSAKLINGIYDKQSKKTILDYLIDDDKINRNFMQLINDDGLSFKEIIQKAQVVGKTDDLKQVVQNLPGSPAIKKGILQSIKIVDELVKVMGHAPESIVIEMARENQTTNQGKRNSQQRYKRIEDAVKNLASELDGNILKEYPTNNQALQNDRLFLYYLQNGKDMYTGEPLDINQLSSYDIDHIIPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVNEKNQKIRTVKIITLKSNLVSNFRKEFGLYKVREINDYHHAHDAYLNAVVAKAILKKYPKLEPEFVYGDYQKYDLKRYISKSRNPKAIDKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 39 - protein, 1373 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGKTILDYLIDDGISNRNFMQLIHDDTLSFKKKIQKEQYIEDQDNIKQVVQSLPGSPAIKKGILQSIKIVDELVKVMGGRKPESIVVEMARENQYTNQGKSNSQQRLKRLEESLKELGSKILKENVPAKLSKIDNNALQNERLYLYYLQNGKDMYTGDDLDIDRLSNYDIDHIIPQAFLKDNSIDNKVLVSSASNRGKSDDVPSLDVVKKRKTFWHQLLKSKLISQRKFDNLTKAERGGLTEDDKAGFIRRQLVETRQITKHVAQLLDSRFNTKRDDNDKVIRDVKIITLKSSLVSQFRKDFKLYKVREINDYHHAHDAYLNAVVATAILKKYPKLEPEFVYGEYKKYDVRKFIAKSDKDLGKATAKLFFYSNLMNFFKKEVRLADGTVVVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 40 - protein, 1372 aa, synthetic construct
MNKPYSIGLDIGTNSVGWAVITDDYKVPSKKMKVLGNTSKKYVKKNLLGALLFESGITAEGRRLKRTARRRYTRRRNRILYLQEIFSTEMNKIDEGFFQRLDDSFLVPDDKRDSKYPIFGNLVEEKAYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLRLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLAKFEGADYFLEKIKREDFLRKQRTFDNGTIPYQVHLAEMRAILHRQGDYYPFLKENKEKIEKILTFRIPYYVGPLARGNRDFAWLTRNSDQAIRPWNFEEIVDQASSAEEFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKDFMDDPKNEEILENIVHTLTIFEDREMIKQRLAQYDSLFDEKVIKALTRRHYTGWGKLSAKLINGIYDKQSKKTILDYLIDDGKINRNFMQLINDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKEHPTDNIQLQNDRLFLYYLQNGKDMYTGEPLDINQLSSYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVNEENQRIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 41 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSQKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQAEFKKHFDLEEKAPLQFSKDTYDEDLENLLGQIGDDFADLFLVAKKLYDAILLSGILTVTDPSTKAPLSASMIERYENHQKDLAALKQFIKSNLSEKYDEVFSDQSKDGYAGYIDGKTTQEAFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEVVDQASSAEEFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTNKTILDYLIDDDKINRNFMQLIHDDGLSFKDIIQKAQVVGKTDDVKQVVQELPGSPAIKKGILQSIKIVDELVKVMGHAPESIVIEMARENQTTNQGRRNSQQRYKKIEEAIKNLDSNLNSKILKEYPTDNQALQNDRLFLYYLQNGKDMYTDEELDINQLSNYDIDHIVPQAFIKDDSLDNRVLTSSKDNRGKSDNVPSLEVVQKRKGFWQQLLDSKLISEHKFNNLTKAERGGLDERDKVGFIKRQLVETRQITKHVAQILDARFNTEVDENNQKIRTVKIITLKSNLVSNFRKEFGLYKVREINDYHHAHDAYLNAVVAKAILKKYPKLEPEFVYGDYQKYDLKRYISKSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 42 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAQLKQFVKTNLPEKYDEVFSDQSKDGYAGYIDGKTTQEAFYVYLKKLLTGLEGADYFLEKIKREDFLRKQRTFDNGSIPYQVHLQEMQAILHRQGEYYPFLKENKEKIQQILTFRIPYYVGPLARGNRDFAWLTRNSDQAIRPWNFEEIVDKASSAEEFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTNKTILDYLIDDDKINRNFMQLINDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGKELDINQLSNYDIDHIIPQAFIKDDSLDNRVLTSSKDNRGKSDNVPSIEVVQKRKAFWQQLLDSKLISERKFNNLTKAERERGGLNELDKVGFIKRQLVETRQITKHVAQILDAKFNTEKDENGKRIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 43 - protein, 1373 aa, synthetic construct
MNKPYSIGLDIGTNSVGWAVVDDDYKVPAKKMRVFGDTDRSHIKKNLLGTLLFDSGETAEGRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGQLNAENTDVQKLFADFVGVYDRTFDDSHLSEITVDASSILTEKISKSRRLENLITHYPKEKKNTLFGNLIALALGLQPNFKTNFKLSEDAKLQFSKDTYEEDLEELLGKIGDDYADLFTSAKNLYDAILLSGILTVDDESTKAPLSASMVKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFAWANYHSEEKITPWNFDKVIDKEKSAEKFITRMTSNDLYLPEEKVLPKHSLLYETYTVYNELTKVKYVNEQGNATFFDSNIKQEIFEQLFKTKRKVTKKDIINYLENAYCIDDVEIMGVEDRFNASLGTYHDLLKIIQDKSFLDDKKNEEIIEDVVLTLTLFEDRDMIRQRLQKYSDIFTKQQLKKLERRHYTGWGRLSYKLINGIRNKENNKTILDFLIDDGRANRNFMQLINDDSLSFKTIIQEAQVVGDVDDIETVVHDLPGSPAIKKGILQSIKIVDELVKVMGHNPDNIVIEMARENQTTNRGRSQSQQRLKKLQESLKELGSSILNKEKPSYIEDKVENSHLQNDKLFLYYIQNGKDMYTGEELDIDHLSDYDIDHIIPQAFIKDDSIDNRVLTSSAKNRGKSDDVPSLDIVRDRKAEWIRLYKSKLISKRKFDNLTKAERGGLTENDKAGFIKRQLVETRQITKHVAQILDARFNTERDENDKVIRDVKVITLKSNLVSQFRKEFGFYKVREINDYHHAHDAYLNAVVGTALLKKYPKLAPEFVYGEYQKYDVRKFISTKDNKDIGKATAKYFFYSNLLNFFKEEVRYANGTIIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 44 - protein, 1371 aa, synthetic construct
MTKPYSIGLDIGTNSVGWAVITDNYKVPSKKMKVLGNTSKKYVKKNLLGALLFESGITAEGRRLKRTARRRYTRRRNRILYLQEIFSTEMNKIDEGFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLINDDGLSFKEIIQKAQVVGKTNDVKQVVQELPGSPAIKKGILQSIKIVDELVKVMGGDPEHIVVEMARENQFTNQGRRNSQQRYKKIEDAIKNLDSNLNSKILKEYPTDNQALQNDRLFLYYLQNGKDMYTGEELDINQLSNYDIDHIVPQAFIKDDSLDNRVLTSSKDNRGKSDNVPSLEVVQKRKAFWQQLLDSKLISERKFNNLTKAERGGLDERDKVGFIRRQLVETRQITKHVAQILDARFNTEVNEKGKKIRKVKIITLKSNLVSNFRKEFGLYKVREINDYHHAHDAYLNAVVAKAILKKYPKLEPEFVYGDYQKYDIRDFIKAKRKTTDDKATAKYFFYSNLLNFFKKEVRYADGTVIVRPIVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 45 - protein, 1373 aa, synthetic construct
MTKPYSIGLDIGTNSVGWAVITDNYKVPSKKMKVLGNTSKKYVKKNLLGALLFESGITAEGRRLKRTARRRYTRRRNRILYLQEIFSTEMSKVDENFFQRLDDSFLVPDDKRDSKYPIFGNLVEEKTYHDEFPTIYHLRKYLADSSKKADLRLVYLALAHMIKYRGHFLIEGDFNSRNNDIKKNFQQFLDSYNAIFESDLSLENSAQVEEIVKDKISKSAKRERVLKLFPDEKSTGLFSEFLKLIVGNQADFKKHFNLEEKAPLHFSKDTYDEDLENLLGQIGDDFADLFLVAKKLYDAILLSGILTVTDPSTKAPLSASMIERYENHQKDLATLKQFIKNNLSEKYDEVFSDQSKDGYAGYIDGKTTQEAFYKYIKNLLSKFEGADYFLDKIERENFLRKQRTFDNGSIPHQIHLQEMHAILHRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIIHTLTIFEDREMIKQRLAQYDSLFDEKVIKALTRRHYTGWGKLSAKLINGIRDKKTGKTILDYLIDDGKINRNFMQLIHDDGLSFKEIIQKAQVVGDTDDLKQVVQELPGSPAIKKGILQSIKIVDELVKVMGHNPENIVVEMARENQFTNQGRRNSQQRYKKIKDAIKNLDSNLNSKILKEYPTNNQALQNDRLFLYYLQNGKDMYTGEALDINQLSNYDIDHIIPQAFIKDDSLDNRVLTSSKDNRGKSDNVPSIEVVEKMKAFWQQLLDSKLISERKFNNLTKAERERGGLNELDKVGFIKRQLVETRQITKHVAQILDARFNTEVNEKKQKIRSVKIITLKSNLVSNFRKEFGLYKVREINDYHHAHDAYLNAVVAKAILKKYPKLEPEFVYGDYQKYDVRKFISTKDNDEIGKATAKYFFYSNLLNFFKTKVRYADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 46 - protein, 1371 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKVYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLEKIEREDFLRKQRTFDNGSIPHQIHLQEMNAILRRQGEYYPFLKENKEKIQQILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGESLDINQLSNYDIDHIIPQAFIKDDSLDNRVLTSSKDNRGKSDNVPSIEIVEKMKGFWQQLLNSKLISERKFNNLTKAERGGLSELDKAGFIKRQLVETRQITKHVAQILDARYNEEVDNNQKIRKVKIITLKSNLVSNFRKEFGLYKVREINDYHHAHDAYLNAVVAKAILKKYPKLEPEFVYGDYQKYDIKRYISKSKDPKDIEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 47 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLSALKQFIKRNLSEKYDEVFSDQSKDGYAGYINGKTTQEAFYKYIKNLLSKFEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEVVDKARSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIIHTLTIFEDREMIKQRLAQYDSLFDEKVIKALTRRHYTGWGKLSAKLINGIYDKQSKKTILDYLIDDGEINRNFMQLIHDDGLSFKEIIQKAQVVGETDDLRQVVQNLPGSPAIKKGILQSIKLVDELVKVMGHEPEQIVIEMARENQTTNQGKRNSQQRYKRIEDGVKNLASDLNGNILKEYPTDNQALQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVNEKGKRIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 48 - protein, 1370 aa, synthetic construct
MKKPYSIGLDIGTNSVGWAVITDSYKVPSKKMKVLGNTSKKYVKKNLLGALLFESGITAEGRRLKRTARRRYTRRRNRILYLQEIFAEEMNKIDESFFHRLDDSFLVPEDKRGSKYPIFATLEEEKEYHKQFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYINGKTTQEAFYKYIKNLLNKVEGADYFLDKIEREDFLRKQRTFDNGSIPHQIHLQEMHAILQRQGEHYPFLKDNKEKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLATYHDLLKIIKDKEFMDDPKNEEILEKIIHTLTLFEDREMIKQRLEQYADIFDKSVLKKLSRRHYTGWGKLSAKLINGIRDKKTGKTILDYLIDDGYSNRNFMQLINDDSLSFKEKIKEAQRSGEGDDLREEVQNLAGSPAIKKGILQSLKIVDELIEVMGYDPEHIVVEMARENQFTNQGRRNSQQRYKKLKNAIKNLDNNLNSKILKEYPTNNQALQNDRLFLYYIQNGKDMYTGEELDIDNLSQYDIDHIIPQAFIKDDSIDNRVLTSSAKNRGKSDDVPSIEIVKDRRNFWKQLLDSQLISQRKFDNLTKAERGGLTEADKAGFIKRQLVETRQITKHVAQILDARFNTKRDENDKVIRDVKVITLKSNLVSQFRKDFQFYKVREINDYHHAHDAYLNAVVGTALIKKYPKLESEFVYGDYKVYDVRRMIAKSEQEIGKATAKRFFYSNILNFFKTEIKLANGEIRKRPLIETNEETGEIVWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 49 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRNISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIEYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGKTILDYLIDDGISNRNFMQLIHDDTLSFKKKIQKAQIIGDKDNIKQVVQSLPGSPAIKKGILQSIKIVDELVKVMGGRKPESIVVEMARENQYTNQGKSNSQQRLKRLEESLKELGSKILKENVPAKLSKIDNNALQNERLYLYYLQNGKDMYTGDDLDIDRLSNYDIDHIIPQAFLKDNSIDNKVLVSSASNRGKSDDVPSLDVVKKRKGFWHQLLKSKLISQRKFDNLTKAERGGLSPEDKAGFIQRQLVETRQITKHVARILDERFNNEVNDKGQRIRKVKIITLKSSLVSQFRKEFGLYKVREINDYHHAHDAYLNAVVATAILKKYPKLEPEFVYGDYQKYDVRKYLSTKDNKDLGKATAKLFFYSNLMNFFKKEVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 50 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLAALKQFIQNNLQEKYDEVFSDQSKDGYAGYINGKTTQEAFYKYIKNLLSKLEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENVVHTLTIFEDREMIKQRLTQYASIFDEKVIKALSRRHYTGWGRLSAKLINGIRDKQSQKTILDYLIDDDKINRNFMQLINDDGLSFKDIIQKAQVVGKTDDVKQVVQELPGSPAIKKGILQSIKIVDELVKVMGHAPESIVIEMARENQTTARGKKNSQQRYKRIEDALKNLAPELDGNILKEYPTDNQALQNDRLFLYYLQNGKDMYTGEELDINQLSNYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVDEKGKKIREVKIVTLKSNLVSNFRKEFGLYKVREINDYHHAHDAYLNAVVAKAILKKYPKLEPEFVYGDYQKYDVKRYISRSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 51 - protein, 1381 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKAYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLATYHDLLNIINDKEFLDDSSNEAIIEEIIHTLTIFEDREMIKQRLSKFENIFDKSVLKKLSRRHYTGWGKLSAKLINGIRDEKSGKTILDYLIDDGVSNRNFMQLIHDDALSFKKKIQKAQIIGDQDNIKQVVQSLPGSPAIKKGILQSIKIVDELVKVMGRNPESIVVEMARENQYTNQGKSNSQQRLKRLEESLKELGSKILKENVPVKLSKIDNKALQNERLYLYYLQNGKDMYTGNDLDIDRLSNYDIDHIIPQAFLKDNSIDNKVLVSSASNRGKSDDVPSIDVVKKRKTFWHQLLKSKLISQRKFDNLTKAERGGLTEEDKAGFIHRQLVETRQITKHVAQLLDSRFNTEKDDNNKAVRTVKIITLKSSLVSQFRKDFKLYKVREINDYHHAHDAYLNAVVATALLKKYPKLAPEFVYGQYEKYEKYKVIDKKSGEISKTKDTSKYGKATAKYFFYSNLMNFFKRVIRYSNGKVIIRPVVEYSKDTGEVAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 52 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSEQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLATLKQFVRTNLPEKYDEVFSDQSKDGYAGYIDGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENVVHTLTIFEDREMIKQRLAQYDSLFDEKVIKALTRRHYTGWGKLSAKLINGICDKQTGKTILDYLIDDGEINRNFMQLIHDDGLSFKDIIQKAQVVGKTDDVKQVVQELPGSPAIKKGILQSIKIVDELVKVMGHNPENIVVEMARENQFTNQGRRNSQQRYKKIEDAIKNLDSNLNSKILKEYPTNNQALQNDRLFLYYLQNGKDMYTGEELDINQLSNYDIDHIVPQAFIKDDSLDNRVLTSSKDNRGKSDNVPSLEVVQKRKAFWQQLLDSKLISERKFNNLTKAERERGGLNELDKVGFIKRQLVETRQITKHVAQILDARFNTEVNEKGQRIRKVKIITLKSNLVSNFRKEFGLYKVREINDYHHAHDAYLNAVVAKAILKKYPKLEPEFVYGDYQKYDVKRYISRSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 53 - protein, 1384 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIEYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGKTILDYLIDDGISNRNFMQLIHDDTLSFKKKIQKKQYIEDQDNIKQVVQSLPGSPAIKKGILQSIKIVDELVKVMGGRKPESIVVEMARENQYTNQGKSNSQQRLKRLEESLKELGSKILKENVPAKLSKIDNNALQNERLYLYYLQNGKDMYTGDDLDIDRLSNYDIDHIIPQAFLKDNSIDNKVLVSSASNRGKSDDVPSLDVVKKRKTFWHQLLKSKLISQRKFDNLTKAERGGLTEDDKAGFIKRQLVETRQITKHVAQILDARFNTKRDDNNKVIRDVKIITLKSSLVSQFRKEFKLYKVREINDYHHAHDAYLNAVVATAILKKYPKLEPEFVYGDYEKHELSDTKGDHKNFDLISKVKSDSSLGKATAKMFFYSNLMNFFKKEVRLADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 54 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPEDKRGSKYPIFGNLAKEKTYHDEFPTIYHLRKYLADSQKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAQLKQFVRRNLPEKYAEVFSDQSKDGYAGYIDGKTTQEAFYKYIKNLLTKFEGAEYLLEKIKREDLLRKQRTFDNGSIPYQVHLQEMKAILQHQGEYYPFLKENKEKIQQILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALIRRHYTGWGKLSAKLINGIYDKQSKKTILDYLIDDGEINRNFMQLIHDDGLSFKEIIQKAQVFGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEALDINQLSSYDIDHIIPQAFIKDDSLDNRVLTSSKDNRGKSDNVPSIEVVQKRKAFWQQLLDSKLISERKYNNLTKAERERGGLTELDKAGFIKRQLVETRQITKHVAQILDSRFNTEVNDEGKRIRKVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 55 - protein, 1372 aa, synthetic construct
MNKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLSLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAIIHRQGEHYPFLKENREKIEKILTFRIPYYVGPLARGNRDFAWLTRNSDQAIRPWNFEEIVDQASSAEEFINKMTNYDLYLPEEKVLPKHSLLYETFAVYNELTKVKFIAEGLRDYQFLDSGQKKQIVNQLFKEKRKVTEKDIIHFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDFLIDDDKINRNFMQLINDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKEHPTDNIALQNDRLFLYYLQNGKDMYTGEPLDINQLSSYDIDHIVPQAFIKDDSIDNRVLTSSKDNRGKSDNVPSLEVVQKRKAFWQQLLDSKLISERKFNNLTKAERGGLDERDKVGFIKRQLVETRQITKHVAQILDARFNTEVDENGKRIRKVKIVTLKSNLVSNFRKEFGLYKVREINDYHHAHDAYLNAVVAKAILKKYPKLEPEFVYGDYQKYDVKRYISRSKDPKDIEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 56 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 57 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKVDESFFQRLDDSFLVPDDKRDSKYPIFGNLVEEKTYHDEFPTIYHLRKYLADSSKKADLRLVYLALAHMIKYRGHFLIEGDFDTRNNNIKGIYQKFLDSYNAIFESDLSLENSKQLEEIVKDKISKSAKRERVLKLFPDEKSTGLFSEFLKLIVGNQADFKKHFELEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKQTNKTILDYLIDDGKINRNFMQLIHDDGLSFKEIIQKAQVVGKTDDVKQVVQELPGSPAIKKGILQSIKIVDELVKVMGHAPESIVIEMARENQTTNQGRRNSQQRYKLIEDGVKNLAKDLDGNILKEYPTDNQALQNDRLFLYYLQNGKDMYTGEALDINQLSNYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDSRFNTEVDETGKRIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTILKKDSVEYSKDTGEIAWNKKKDFAIVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 58 - protein, 1372 aa, synthetic construct
MKKSYSIGLDIGTNSVGWAVVDDDYKVPAKKMRVFGDTDRSHIKKNLLGTLLFDSGETAESRRLKRTARRRYTRRRNRILYLQEIFAEEMNKVDDSFFHRLDESFLTDDDKTFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLENLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFIKANKPELYHDIFKDETKNGYAGYIENGVKQDEFYKYLKETLSKIAGSDYFLDKIEREDFLRKQRTFDNGSIPHQIHLQEMHAILRRQGDYYPFLKENQAKIEKILTFRIPYYVGPLARKDSRFAWANYHSDEPITPWNFDEVVDKEKSAEKFITRMTLNDLYLPEEKVLPKHSHVYETYAVYNELTKIKYVNEQGKSFFFDANMKQEIFEHVFKENRKVTKEKFLNYLNKEFPEYRIQDLIGLDKENKSFNASLGTYHDLKKILDKSFLDDKENETIIEDIIQTLTLFEDRDMIRQRLQKYSDIFTPQQLKKLERRHYTGWGRLSYKLINGIRNKENNKTILDYLIDDGYANRNFMQLINDDTLPFKQIIQKSQVVGDIDDIKAVVHDLPGSPAIKKGILQSVKIVDELVKVMGHNPDNIVIEMARENQTTNRGRSQSQQRLKKLQDSLKELGSNILNEEKPSYIEDKVENSHLQNDKLFLYYIQNGKDMYTGEELDIDHLSDYDIDHIIPQAFIKDDSIDNRVLTSSAKNRGKSDDVPSLDIVHDRKADWIRLYKSGLISKRKFDNLTKAERGGLTEADKAGFIKRQLVETRQITKHVAQILDARFNTERDENDKVIRDVKVITLKSNLVSQFRKDFQFYKVREINDYHHAHDAYLNAVVGTALLKKYPKLAPEFVYGEYKKYDIRKFITNSSDKATAKYFFYSNLLNFFKTKVRYADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 59 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKANLPEKYDEVFSDQSKDGYAGYIDGKTTQEAFYKYIKNLLSKFEGADYFLEKIEREDFLRKQRTFDNGSIPHQIHLQEMNAILHRQGDYYPFLKENKEKIQQILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDFLIDDDKINRNFMQLINDDGLSFKEIIQKAQVVGKTDDVKQVVQELPGSPAIKKGILQSIKIVDELVKVMGHAPESIVIEMARENQTTNQGRRNSQQRYKKIEEAIKNLDSNLNSKILKEYPTNNQALQNDRLFLYYLQNGKDMYTGEELDINQLSNYDIDHIVPQAFIKDDSLDNRVLTSSKDNRGKSDNVPSLEVVQKRKGFWQQLLDSKLISERKFNNLTKAERGGLDERDKVGFIKRQLVETRQITKHVAQILDARFNKEVNDKKQRIRKVKIITLKSNLVSNFRKEFGLYKVREINDYHHAHDAYLNAVVAKAILKKYPKLEPEFVYGDYQKYDIKRYISRSKDPKDVEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 60 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMSKIDESFFQRLDDSFLVPDDKRDSKYPIFGNLAQEKTYHDEFPTIYHLRKYLADSSKKADLRLVYLALAHMIKYRGHFLIEGDFNSKNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLEKIEREDFLRKQRTFDNGTIPYQVHLEEMKAILHRQGDYYPFLKENKEKIQQLLTFRIPYYVGPLARGNRDFAWLTRNSDQAIRPWNFEEVVDKARSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDPKNEEILENIVHTLTIFEDREMIKQRLTQYASIFDEKVIKALSRRHYTGWGKLSAKLINGIRDKQSRKTILDYLIDDGEINRNFMQLIHDDGLSFKDIIQKAQVVGKTDDVKQVVQELPGSPAIKKGILQSIKLVDELVKVMGHAPESIVIEMARENQTTARGKKNSQQRYKRIEDALKNLAPGLDSNILKEHPTDNIQLQNDRLFLYYLQNGKDMYTGKSLDINQLSNYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVNEKNQKIRKVKIVTLKSNLVSNFRKEFGLYKVREINDYHHAHDAYLNAVVAKAILKKYPKLEPEFVYGDYQKYDVKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 61 - protein, 1372 aa, synthetic construct
MNKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKVYHDEFPTIYHLRKYLADSSKKADLRLVYLALAHMIKYRGHFLIEGDFNSRNNDIKKNFQDFLDSYNAIFESDLSLENSAQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQNDLSALKQFIRRNIPEKYDEVFSDQSKDGYAGYIDGKTTQEAFYKYIKNTLSKIEGADYFLDKIEREDFLRKQRTFDNGSIPHQIHLQEMNAILHHQGEYYPFLQENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDFLIDDDKINRNFMQLINDDGLSFKDIIQKAQVVGKTDDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSLEVVQKRKAFWQQLLDSKLISEHKFNNLTKAERGGLDERDKVGFIRRQLVETRQITKHVAQILDARFNTEVNEKNQKIRKVKIITLKSNLVSNFRKEFGLYKVREINDYHHAHDAYLNAVVAKAILKKYPKLEPEFVYGDYQKYDLKKYIPKSKSHGTIEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 62 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAQLKQFVKTNLPEKYDEVFSDQSKDGYAGYIDGKTTEEAFYKYIKNILNNVKGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDFLIDDDKINRNFMQLINDDGLSFKEIIQKAQVVGENDNLKQVVQNLPGSPAIKKGILQSIKIVDELVKVMGGDPEHIVVEMARENQFTNQGRRNSQQRYKKIENAIKNLDSSLNSKILKEYPTNNQALQNDRLFLYYLQNGKDMYTGEPLDINQLSNYDIDHIVPQAFIKDDSLDNRVLTSSKDNRGKSDNVPSIEIVEKMKGFWQQLLDSKLISERKFNNLTKAERGGLDERDKVGFIKRQLVETRQITKHVAQILDARFNTEVDENNQKIRTVKIITLKSNLVSNFRKEFGLYKVREINDYHHAHDAYLNAVVAKAILKKYPKLEPEFVYGDYQKYDLKRYLSKSGNPKAIDKATQKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 63 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQEFLDSYNAIFESDLSLENSAQVEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLAALKQFVKANLPEKYDEVFSDQSKDGYAGYIDGKTTQEAFYKYIKNLLSKLEGADYFLDKIEREDFLRKQRTFDNGSIPHQIHLQEMNAILRRQGEYYPFLKENKEKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIHFLHNVDGYDGIELKGIEKQFNASLSTYHDLLKIIKDKEFMDDPKNEEILENIVHTLTIFEDREMIKQRLAQYDSLFDEKVIKALARRHYTGWGKLSAKLINGIHDKQSQKTILDYLIDDDKINRNFMQLINDDGLSFKDIIQKAQVVGKTDDVKQVVQELPGSPAIKKGILQSIKIVDELVKVMGHAPESIVIEMARENQTTARGKKNSQQRYKRIEDAIKGLSSDLNHKILKEHPTDNQALQNDRLFLYYLQNGKDMYTGEELDINQLSNYDIDHIIPQAFIKDDSLDNRVLTSSKDNRGKSDNVPSIEVVQKRKAFWQQLLDSKLISERKFNNLTKAERGGLDEKDKVGFIRRQLVETRQITKHVAQILDARFNTEVDDKGKRIRKVKIVTLKSNLVSNFRKEFGLYKVREINDYHHAHDAYLNAVVAKAILKKYPKLEPEFVYGDYQKYDVKRYISRSKEPKDIEKATEKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 64 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMNKIDDAFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIEYLHAIDGYDGIELKGIEKQFNSSLATYHDLLNIINDKEFLDDSSNEAIIEEIIHTLTIFEDREMIKQRLSKFENIFDKSVLKKLSRRHYTGWGKLSAKLINGIRDEKSGKTILDYLIDDGISNRNFMQLIHDDTLSFKKKIQKAQIIGDQDNIKQVVQSLPGSPAIKKGILQSIKIVDELVKVMGRNPESIVVEMARENQYTNQGKSNSQQRLKRLEESLKELGSKILKENVPAKLSKIDNNALQNERLYLYYLQNGKDMYTGKDLDIDRLSNYDIDHIIPQAFLKDNSIDNKVLVSSASNRGKSDDVPSLEVVKKRKTFWHQLLKSKLISQRKFDNLTKAERGGLTENDKAGFIKRQLVETRQITKHVAQILDARFNTEKDDNNKAIREVKIITLKSSLVSQFRKDFQLYKVREINDYHHAHDAYLNAVVATAILKKYPKLEPEFVYGEYKKYDVRKFVAKDDKSLGKATAKMFFYSNLMNFFKKEVRFADGTVIVRPLIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 65 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGKTILDYLIDDGISNRNFMQLIHDDTLSFKKKIQKEQYIEDQDNIKQVVQSLPGSPAIKKGILQSIKIVDELVKVMGGRKPESIVVEMARENQYTNQGKSNSQQRLKRLEESLKELGSKILKENVPAKLSKIDNNALQNERLYLYYLQNGKDMYTGEDLDIDRLSNYDIDHIIPQAFLKDNSIDNKVLVSSASNRGKSDDVPSLDVVKKRKGFWHQLLKSQLISQRKFDNLTKAERGGLTEDDKAGFIKRQLVETRQITKHVAQILDARFNTEPDENGKRIRKVKIITLKSSLVSQFRKEFGLYKVREINDYHHAHDAYLNAVVATAILKKYPKLEPEFVYGDYQKYDIRKYLSTKDNKDLGKATAKMFFYSNLMNFFKKEVRLSDGTVVVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 66 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFVRANLPEKYDEVFSDQSKDGYAGYIDGKTTQEAFYKYIKNLLSKFEGADYFLDKIEREDFLRKQRTFDNGSIPHQIHLQEMNAIIRRQGEYYPFLKENKEKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKDFMDDPKNEEILENIVHTLTIFEDREMIKQRLAQYDSLFDEKVIKALTRRHYTGWGKLSAKLINGIRDKKSGKTILDYLIDDDKINRNFMQLIHDDGLSFKEIIQKAQVVGKTDDLKQVVQELPGSPAIKKGILQSIKIVDELVKVMGHAPESIVIEMARENQTTNQGRRNSQQRYKLIEDGVKNLASELDGNILKEYPTDNQALQNDRLFLYYLQNGKDMYTGEPLDINHLSDYDIDHIVPQAFIKDDSIDNRVLTSSKDNRGKSDNVPSLEIVEKMKGFWQQLLDSKLISERKFNNLTKAERGGLDERDKVGFIKRQLVETRQITKHVAQILDARFNTEVNEKNQKIRSVKIVTLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 67 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGEFNSKNNDIKKNFQEFLDSYNAIFESDLSLENNAQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIRTNLPEKYDEVFSDDSKDGYAGYIDGKTTQEEFYKYIKNLLSKLEGADYFLEKIEREDFLRKQRTFDNGSIPHQIHLQEMNAILRRQGEYYPFLQENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGNTILDYLIDDDKINRNFMQLIHDDGLSFKEIIQKAQVVGKTDDVKQVVQELPGSPAIKKGILQSIKIVDELVKVMGHEPEQIVVEMARENQTTNQGRRNSRQRYKLLDDGVKNLASDLNGNILKEYPTDNQALQNDRLFLYYLQNGKDMYTGEPLDINQLSSYDIDHIIPQAFIKDDSLDNRVLTSSKDNRGKSDNVPSLEIVEKMKGFWQQLLDSKLISERKYNNLTKAERERGGLNELDKVGFIKRQLVETRQITKHVAQILDARFNTEVNDKKQKIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 68 - protein, 1371 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLEKIEREDFLRKQRTFDNGSIPHQIHLQEMNAILRRQGEYYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDYLIDDDKINRNFMQLINDDGLSFKEIIQKAQVVGKTDDVKQVVQELPGSPAIKKGILQSIKIVDELVKVMGHEPESIVIEMARENQTTNQGKRNSQQRYKRLEDGVKNLASDLNGNILKEYPTDNQALQNDRLFLYYLQNGKDMYTGEPLDINQLSSYDIDHIIPQAFIKDDSLDNRVLTSSKDNRGKSDNVPSIEVVQKRKGFWQQLLDSKLISERKFNNLTKAERGGLDERDKVGFIKRQLVETRQITKHVAQILDSRFNTEVDESGKRIRKVKIITLKSNLVSNFRKEFGLYKVREINDYHHAHDAYLNAVVAKAILKKYPKLEPEFVYGDYQKYDVRKYLSTKDDKDFGKATAKLFFYSNLMNFFKKEVRFADGTIIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 69 - protein, 1372 aa, synthetic construct
MNKPYSIGLDIGTNSVGWSVITDDYKVPSKKMKVLGNTDKKYIKKNLLGALLFEGGETAEGRRLKRTARRRYTRRRNRILYLQEIFSTEMSKIDESFFQRLDDSFLVPDDKRDSKYPIFANLAQEKTYHDKFPTIYHLRKYLADSSKKADLRLVYLALAHMIKYRGHFLIEGDFNSRNNDIKKNFQNFLDSYNAIFESDLSLENSAQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKTNLPEKYDEVFSDQSKDGYAGYIDGKTTQEAFYKYIKNTLNNVKGADYFLDKIEREDFLRKQRTFDNGSIPHQIHLQEMNAIIRRQGEHYPFLKENREKIEKILTFRIPYYVGPLARGNRDFAWLTRNSDQAIRPWNFEEVVDKASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDTLFDEKVIKALTRRHYTGWGKLSAKLINGICDKQTGETILDFLIDDDKINRNFMQLINDDGLSFKEIIQKAQVVGKTDDVKQVVQELPGSPAIKKGILQSIKIVDELVKVMGHDPESIVIEMARENQTTNQGRRNSQQRYKKIEEAIKNLDSNLNSKILKEYPTDNQALQNDRLFLYYLQNGKDMYTDEELDINQLSNYDIDHIVPQAFIKDDSIDNRVLTSSKDNRGKSDNVPSLEVVQKRKAFWQQLLDSKLISERKFNNLTKAERGGLDERDKVGFIKRQLVETRQITKHVAQILDSRFNTEVDENGKRIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEVAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 70 - protein, 1372 aa, synthetic construct
MTKPYSIGLDIGTNSVGWAVITDDYKVPSKKMKVLGNTSKKYVKKNLLGALLFESGITAEGRRLKRTARRRYTRRRNRILYLQEIFATEMAKVDESFFQRLDDSFLVPDDKRDSKYPIFGNLVEEKTYHDEFPTIYHLRKYLADSSKKADLRLVYLALAHMIKYRGHFLIEGDFNSRNNDIKKNFQNFLDSYNAIFESDLSLENSAQVEEIVKDKISKSAKRERVLKLFPDEKSTGLFSEFLKLIVGNQAEFKKHFDLEEKAPLQFSKDTYDEDLENLLGQIGDDFADLFLVAKKLYDAILLSGILTVTDPSTKAPLSASMIERYENHQKDLAALKQFVKANLPEKYDEVFSDQSKDGYAGYIDGKTTQEAFYKYIKNLLSKFEGADYFLEKIEREDFLRKQRTFDNGSIPHQIHLQEMNAILRRQGEYYPFLKENREKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDTLFDEKVIKALTRRHYTGWGKLSAKLINGISDKQTGDTILDFLIDDDKINRNFMQLINDDGLSFKEIIQKAQVVGKTDDLKQVVQELPGSPAIKKGILQSIKIVDELVKVMGHAPESIVIEMARENQTTNQGRRNSRQRYKLIEDGVKNLASDLNGNILKEYPTDNQALQNDRLFLYYLQNGKDMYTGEALDINQLSNYDIDHIVPQAFIKDDSLDNRVLTSSKDNRGKSDNVPSLEVVEKMKGFWQQLLDSKLISERKFNNLTKAERGGLDERDKVGFIKRQLVETRQITKHVAQILDARFNTEVNEKGQKIRKVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEKVYYADGTIIKRDSVEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 71 - protein, 1376 aa, synthetic construct
MKKPYSIGLDIGTNSVGWAVVTDDYKVPAKKMKVLGNTDKSHIKKNLLGALLFDSGNTAEDRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEEIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLSEKYDEVFSDQSKDGYAGYIEGKTTQEAFYKYIKKAIEKIEGSDYFLDKIERENFLRKQRTFDNGSIPHQIHLQEMHAIIHRQGEYYPFLKENKEKIEKILTFRIPYYVGPLARGKSDFAWLTRKSDDAIRPWNFEEMVDKESSAEAFIHRMTNYDLYLPEEKVLPKHSLLYEKFAVYNELTKVRYVTEQGKSFFFDANMKQEIFDGIFKKYRKVTKEKLMDFLGKEFDEFRIVDLMGLDKDNKSFNASLGTYHDLKKIVSKDFLDNPENEDILENVVLTLTLFEDREMIRKRLEKYKDVLTEEQRKKLERRHYTGWGRLSAKLINGIRDKVTRKTILDYLIDDGTSNRNFMQLIHDDTLSFVDEIRLAQGSGEAEDYREEVQNLAGSPAIKKGILQSLKIVDELVGVMGYDPEHIVVEMARENQFTNQGRRNSQQRYKKIKDAIKNLDSNLNSKILKEYPTDNQALQNDRLFLYYLQNGKDMYTGEALDINQLSNYDIDHIIPQAFIKDDSLDNRVLTSSKDNRGKSDNVPSIEVVEKMKAFWQQLLDSKLISERKYNNLTKAERERGGLNELDKVGFIKRQLVETRQITKHVAQILDARFNTEVDEKGKRIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 72 - protein, 1381 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLSTYHDLLKIIKDKEFLDDASNEAIIEEIIHTLTIFEDREMIKQRLSKFENIFDKSVLKKLSRRHYTGWGKLSAKLINGIRDEKSGKTILDYLIDDGVSNRNFMQLIHDDTLSFKKKIQKAQIIGDQDNIKQVVQSLPGSPAIKKGILQSIKIVDELVKVMGRNPESIVVEMARENQYTNQGKSNSQQRLKRLEESLKELGSKILKENVPAKLSKIDNNALQNERLYLYYLQNGKDMYTGDDLDIDRLSNYDIDHIIPQAFLKDNSIDNKVLVSSASNRGKSDDVPSLDVVKKRKTFWHQLLKSQLISQRKFDNLTKAERGGLTEKDKAGFIKRQLVETRQITKHVAQILDSRFNTKRDDNDKVIRNVKIITLKSSLVSQFRKEFGLYKVREINDYHHAHDAYLNAVVATAILKKYPKLEPEFVYGDYKTYTYDELKQGDLRQIKRADIDKSLGKATAKMFFYSNLMNFFKKEVRLADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 73 - protein, 1376 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKVYHDEFPTIYHLRKYLADSSKKADLRLVYLALAHMIKYRGHFLIEGEFNSKNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKTNLPEKYDEVFSDQSKDGYAGYIDGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEDLTRYQFLDKKQKKDIFDTFFKAEDKRKVTEKDIIHYLHNVDGYDGIELKGIEKQFNASLSTYHDLLKIIKDKEFMDDAKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTDDIKQVVQNLPGSPAIKKGILQSIKIVDELVKVMGKDPEHIVVEMARENQFTNQGRRNSQQRYKKIKDAIKNLDSNLNSKILKEYPTNNQALQNDRLFLYYLQNGKDMYTGEPLEINQLSNYDIDHIIPQAFIKDDSLDNRVLTSSKDNRGKSDNVPSIEVVEKMKGFWKQLLDSKLISERKYNNLTKAERERDGLNELDKVGFIKRQLVETRQITKHVAQILDARFNTEVNEKNQKIRNVKIITLKSNLVSNFRKEFGLYKVREINDYHHAHDAYLNAVVAKAILKKYPKLEPEFVYGDYQKYDLKRYISRSKDPKEIEKATQKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 74 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRGSKYPIFGNLAKEKTYHDEFPTIYHLRKYLADSSKKADLRLVYLALAHMIKYRGHFLIEGDFNSRNNDIKKNFQNFLDSYNAIFESDLSLENSEQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDTLFDEKVIKALTRRHYTGWGKLSAKLINGISDKQTGKTILDFLIDDDKINRNFMQLINDDGLSFKEIIQKAQVIGETDNIKQVVQNLPGSPAIKKGILQSIKIVDELVKVMGHDPESIVIEMARENQTTNQGRRNSQQRYKRIEEAIKNLDSNLNSKILKEYPTDNQALQNDRLFLYYLQNGKDMYTGQELDINQLSNYDIDHIVPQAFIKDDSLDNRVLTSSKDNRGKSDNVPSIEIVQKRKAFWQQLLDSKLISERKFNNLTKAERGGLNERDKVGFIKRQLVETRQITKHVAQILDARFNTEVNAKGKKIRKVKIITLKSNLVSNFRKEFGLYKVREINDYHHAHDAYLNAVVAKAILKKYPKLEPEFVYGDYQKYDVKRYISRSKDPKDIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 75 - protein, 1365 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKERLLKLFPGEKNSGILAEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRNISLETYNEVFKDDTKNGYAGYIDGKTNQEDFYVYLKKLLTGLEGADYFLEKINREDLLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLSTYHDLLKIIKDKEFLDDSSNEAIIEEIIHTLTIFEDREMIKQRLSKFENIFDKSVLKKLSRRHYTGWGKLSAKLINGIRDEKSGKTILDYLIDDGISNRNFMQLIHDDTLSFKKKIQKAQIIGDQDNIKQVVQSLPGSPAIKKGILQSIKIVDELVKVMGRRPESIVVEMARENQYTNQGKSNSQQRLKRLEESLKELGSKILKENVPAKLSKIDNNALQNERLYLYYLQNGKDMYTGQELDIDRLSNYDIDHIIPQAFLKDNSIDNKVLVSSASNRGKSDDVPSLDVVKKRKTFWHQLLKSKLISQRKFDNLTKAERGGLTEDDKAGFIKRQLVETRQITKHVAQILDARFNTEVNEKNQKIRTVKIVTLKSNLVSNFRKEFELYKVREINDYHHAHDAYLNAVVAKAILTKYPKLEPEFVYGDYPKYNSFRERKSATEKVYFYSNIMNTFKKSITLADGTVIDRPLIEVNEETGESVWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 76 - protein, 1372 aa, synthetic construct
MNKPYSIGLDIGTNSVGWAVITDDYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLAKEKTYHDEFPTIYHLRKYLADSTKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIDRYENHQKDLAALKQFIRKNLPEKYDEVFSDESKDGYAGYIDGKTTQENFYKYIKNAISKIEGADYFLEKIEREDFLRKQRTFDNGSIPHQIHLQEMNAILHNQGEYYPFLKENKEKIEKILTFRIPYYVGPLARGNRDFAWLTRNSDQAIRPWNFEEVVDQASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDTLFDEKVIKALTRRHYTGWGKLSAKLINGIRDKKSGKTILDYLIDDDKINRNFMQLIHDDGLSFKEIIQKAQVVGDSDNLKQVVQNLPGSPAIKKGILQSIKIVDELVKVMGHDPEQIVIEMARENQTTNEGRRNSRQRYKLIEDGVKNLAKDLDGNILKEYPTDNQALQNDRLFLYYLQNGKDMYTGEPLDINQLSSYDIDHIVPQAFIKDDSLDNRVLTSSKDNRGKSDNVPSLEVVQKRKAFWQQLLDSKLISEHKFNNLTKAERGGLDERDKVGFIRRQLVETRQITKHVAQILDARFNTEVNEKNQKIRTVKIVTLKSNLVSNFRKEFGLYKVREINDYHHAHDAYLNAVVAKAILKKYPKLEPEFVYGDYQKYDLKRYISKSKDPKEVEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 77 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMNKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLATLKQFIKTNLPEKYDEVFSDQSKDGYAGYIDGKTTQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKDKRKVTEKDIIQYLHNVDGYDGIELKGIEKQFNASLSTYHDLLKIIKDKEFMDDPKNEEILENIVHTLTIFEDREMIKQRLAKYANIFDKSVLKKLARRHYTGWGKLSAKLINGIYDKQSRKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDSLKNLASGLDSNILKENPTDNIQLQNDRLFLYYLQNGKDMYTGESLDINQLSSYDIDHIIPQAFIKDDSLDNRVLTSSKDNRGKSDNVPSIEVVQKRKAFWQQLLDSKLISERKFNNLTKAERGGLDERDKVGFIRRQLVETRQITKHVAQILDARFNTEVNEKKQKIRKVKIITLKSNLVSNFRKEFRLYKVREINDYHHAHDAYLNAVVAKAILKKYPKLEPEFVYGDYQKYDLKRYISKSKDPKEIEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 78 - protein, 1372 aa, synthetic construct
MTKPYSIGLDIGTNSVGWAVITDNYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSQKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQFLHTVDGYDGIELKGIEKQFNASLSTYHDLLKIIKDKEFMDDPKNEEILENIVHTLTIFEDREMIKQRLAQYDSLFDEKVIKALIRRHYTGWGKLSAKLINGIYDKQSKKTILDYLIDDDKINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKEHPTDNIQLQNDRLFLYYLQNGRDMYTGEPLDINQLSSYDIDHIIPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDIKRYIRKFQPSKEIDKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 79 - protein, 1376 aa, synthetic construct
MKKPYSIGLDIGTNSVGWAVVTDDYKVPAKKMKVLGNTDKSHIKKNLLGALLFDSGETAEGRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVKDPSTKAPLSASMIKRYAEHHEDLEKLKEFVKANAPELYHDIFKDESKNGYAGYIENGVKQDEFYKYLKNTLSKIEGSDYFLDKIEREDFLRKQRTFDNGSIPHQIHLQEMNAIIRRQGEYYPFLQENKEKIEKILTFRIPYYVGPLARGNRDFAWLTRNSDEAIRPWNFEEVVDKASSAEDFINKMTNYDLYLPEEKVLPKHSLLYEKFAVYNELTKVRYVTEQGKSFFFDANMKQEIFDKTFKVYRKVTKEKLMDFLGKEFDEFRIVDLIGLDKDNKSFNASLGTYHDLKKIVSKDFLDNPENEDILENVVLTLTLFEDREMIRKRLEKYKDVLTEEQQKKLERRHYTGWGRLSAKLINGIRNKTTRKTILDYLIDDGTSNRNFMQLIHDDTLSFVDEIRLAQGSGEAEDYRAEVQNLAGSPAIKKGILQSLKIVDELIEVMGYEPEHIVVEMARENQFTNQGRRNSQQRYKKIENAIKNLDSNLNSKILKEYPTNNQALQNDRLFLYYLQNGKDMYTGEALDINQLSNYDIDHIIPQAFIKDDSLDNRVLTSSKDNRGKSDNVPSIEVVEKMKAFWQQLLDSKLISERKYNNLTKAERERGGLNELDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 80 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFDSRNNDIKKNYQNFLDSYNAIFESDLSLENNAQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLSEKYDEVFSDQSKDGYAGYINGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYASIFDEKVIKALTRRHYTGWGRLSAKLINGIRDKQSRKTILDYLIDDDKINRNFMQLINDDGLSFKDIIQKAQVVGKTDDVKQVVQELPGSPAIKKGILQSIKIVDELVKVMGKDPESIVIEMARENQTTNQGRRNSQQRYKRIEEAIKNLSIDLNSKILKEYPTDNQALQNDRLFLYYLQNGKDMYTGEELDINQLSNYDIDHIVPQAFIKDDSLDNRVLTSSKDNRGKSDNVPSIEVVQRRKAFWQQLLDSKLISERKFNNLTKAERGGLDERDKVGFIKRQLVETRQITKHVAQILDARFNTEVNENNQRIRKVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIVKRENIEYSKDTGEVAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 81 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSKNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKDFMDDPKNEEILENIVHTLTIFEDREMIKKRLEQYDSIFDEKVIKALTRRHYTGWGRLSAKLINGIRDKQSNKTILDYLIDDDKINRNFMQLINDDGLSFKSIISKAQAGSHSDDLKEVVGELAGSPAIKKGILQSLKIVDELVKVMGYEPEQIVVEMARENQTTNQGRRNSRQRYKLLDDGIKNLAKDLDGNILKEYPTNNQALQNDRLFLYYLQNGKDMYTGEALDINQLSSYDIDHIVPQAFIKDDSIDNRVLTSSKDNRGKSDNVPSLEVVQKRKAFWQQLLDSKLISERKFNNLTKAERGGLDERDKVGFIRRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 82 - protein, 1379 aa, synthetic construct
MKKSYSIGLDIGTNSVGWSVVTDDYKVPAKKMKVFGNTDKKYIKKNLLGALLFDSGETAEGTRLKRTARRRYTRRRNRILYLQEIFAKEMAKVDESFFQRLEESFLTDDDKNFDSHPIFGNKAEEDAYHEQFPTIYHLRKHLADSSEKADLRLVYLALAHMIKFRGHFLIEGQLKAENTNVQTLFNDFVEVYDKTVEESHLAEITVDALSILTEKVSKSRRLENLLKYYPTEKKNTLFGNLIALSLGLQPNFKTNFKLSEDAKLQFSKDTYEEDLEELLGKIGDEYADLFTSAKNLYDAILLSGILTVDDKSTKAPLSASMLKRYVEHHEDLEKLKDFVKANKPELYHDIFKDETKNGYAGYIENGVKQDEFYKYLKNTLSKIAGSDYFLDKIEREDFLRKQRTFDNGSIPHQVHLQEMRAILRRQGEYYPFLKENQAKIEKILTFRIPYYVGPLARKDSRFAWAEYHSDEKITPWNFDKVIDKESSARAFIEHMTNNDLYLPEEKVLPKHSPLYEKYTVYNELTKVKYVTEQGKSSFFDANMKQEIFEHVFKKNRKVTKDKFLNYLNKEFPEYRIHDLIGLDKENKSFNASLGTYHDLKKILDKSFLDNKENEEIIEDVVLTLTLFEDRDMIRQRLQKYSDIFTKDQLKKLERRHYTGWGRLSYKLINGIRDKQSNKTILDYLLEDDGVKKNINRNFMQLINDDSLSFKTIIQEAQVIGDIDDIKAVVHDLPGSPAIKKGILQSVKIVDELVKVMGHNPDNIVIEMARENQTTNRGRSQSQQRLKKLQESLKELGSNILNEEKPSYIEDKVENSHLQNDRLFLYYIQNGKDMYTGDELDIDHLSDYDIDHIIPQAFIKDNSIDNRVLTSSAKNRGKSDDVPSLDIVRERKADWIRLYKAGLISKRKFDNLTKAERGGLTENDKAGFIKRQLVETRQITKHVAQILDARFNTKRDENDKVIRDVKIITLKSNLVSQFRKEFGFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEVVWNKERDFAIVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 83 - protein, 1372 aa, synthetic construct
MTKPYSIGLDIGTNSVGWAVITDDYKVPSKKMKVLGNTSKKYVKKNLLGALLFESGITAEGRRLKRTARRRYTRRRNRILYLQEIFATEMNKIDESFFQRLDDSFLVPDDKRDSKYPIFGNLAQEKTYHDEFPTIYHLRKYLADSSKKADLRLVYLALAHMIKYRGHFLIEGDFNSRNNDIKKNFQNFLDSYNAIFESDLSLENSEQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYINGKTTQEAFYKYIKNLLSKFEGADYFLDKIEREDFLRKQRTFDNGSIPHQIHLQEMNAILRRQGEHYPFLKENREKIEKILTFRIPYYVGPLARGNRDFAWLTRNSDQAIRPWNFEEIVDQASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDYLIDDDKINRNFMQLINDDGLSFKEIIQKAQVVGKTDDLKQVVQELPGSPAIKKGILQSIKIVDELVKVMGYEPEQIVIEMARENQTTNQGRRNSQQRYKLIEDGVKNLASDLNGNILKEYPTDNQALQNDRLFLYYLQNGKDMYTGEALDINQLSNYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVDESGKRIRKVKIITLKSNLVSNFRKEFGLYKVREINDYHHAHDAYLNAVVAKAILKKYPKLEPEFVYGDYQKYDLKRYISKSKNPKEVDKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 84 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLPEKYDEVFSDQSKDGYAGYIDGKTTQEAFYKYIKNLLSKFEGADYFLEKIEREDFLRKQRTFDNGSIPHQIHLQEMNAILRHQGEYYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSVFDEKVIKALARRHYTGWGKLSAKLINGIYDKQSKKTILDYLIDDDKINRNFMQLINDDGLSFKDIIQKAQVVGKTDDVKQVVQELPGSPAIKKGILQSIKIVDELVKVMGSDPESIVIEMARENQTTNQGRRNSQQRYKKIKEAIKNLDSELNSKILKEYPTNNQALQNDRLFLYYLQNGKDMYTGEPLDINQLSSYDIDHIVPQAFIKDDSLDNRVLTSSKDNRGKSDNVPSIEIVERMKGFWQQLLNSKLISERKFNNLTKAERGGLDERDKVGFIKRQLVETRQITKHVAQILDARFNTEVDSKGKKIRKVKIITLKSNLVSNFRKEFGLYKVREINDYHHAHDAYLNAVVAKAILKKYPKLEPEFVYGDYQKYDLKRYISKSKNPKSIDKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 85 - protein, 1366 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMSKIDESFFQRLDDSFLVPDDKRDSKYPIFGNLVEEKVYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNASLSTYHDLLKIIKDKEFLDDSENEAIIEEIIHTLTIFEDREMIKQRLSKYEDVFSKSVLKKLSRRHYTGWGKLSAKLINGIRDEKSGKTILDYLIDDGVSNRNFMQLIHDDTLSFKKKIQKAQIIGDQDNIKQVVQSLPGSPAIKKGILQSIKIVDELVKVMGRNPESIVVEMARENQYTNQGKSNSQQRLKRLEESLKELGSKILKENVPAKLSKIDNNALQNERLYLYYLQNGKDMYTGEELDIDRLSDYDIDHIIPQAFIKDNSIDNKVLVSSASNRGKSDDVPSLDVVKKRKGFWHQLLKSKLISQRKFDNLTKAERGGLTDDDKAGFIKRQLVETRQITKHVAQILDARFNVKRDDDNKVIRDVKIVLLKSSLVSQFRKDFELYKVREINDFHHAHDAYLNAVVASALLKKYPKLEPEFVYGDYSKSHISKEQDKATAKYFFYSNLLNFFKSDQKYLTDGTVVFRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 86 - protein, 1373 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFAAEMNKIDESFFHRLDDSFLVPEDKRGSKYPIFGNLEEEKAYHEKFPTIYHLRKYLADSSKKADLRLVYLALAHMIKYRGHFLIEGDFNSRNNDIKKSFQNFLDSYNAIFESDLSLEQNAQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYINGKTTQEAFYKYIKNLLSKLEGADYFLDKIEREDFLRKQRTFDNGSIPHQIHLQEMNAILRRQGEYYPFLKENREKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDFLIDDDKINRNFMQLINDDGLSFKDIIQKAQVVGKTDDVKQVVQELPGSPAIKKGILQSIKIVDELVKVMGHAPESIVIEMARENQTTNQGKRNSQQRYKRIEEAIKNLAPELDGNILKEYPTDNQALQNDRLFLYYLQNGKDMYTGEELDINQLSNYDIDHIVPQAFIKDDSLDNRVLTSSKDNRGKSDNVPSLEVVQKRKAFWQQLLDSKLISERKYNNLTKAERERGGLNELDKVGFIKRQLVETRQITKHVARILDERFNEEVDENKRIRKVKIITLKSNLVSNFRKEFELYKVREINDYHHAHDAYLNAVVAKAILKKYPKLEPEFVYGDYQKYDIKRYISRSKDSKEIDKATEKYFFYSNLLNFFKEEVHYADGTVVFRRNIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 87 - protein, 1370 aa, synthetic construct
MKKPYSIGLDIGTNSVGWAVVTDDYKVPAKKMKVLGNTNKESIKKNLIGALLFDAGNTAADRRLKRTARRRYTRRRNRILYLQEIFAEEMNKVDESFFHRLDDSFLVPEDKRGSKYPIFATLEEEKEYHKKFPTIYHLRKHLADSKEKADLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGMRDYQFLDSGQKKKIVSQLFEDKRKVTEKDIIHYLHTIDGYDGIELSGIEKQFNASLSTYHDLLKIIKDKAFLDDSENEAIIEEIIHTLTIFEDREMIKQRLAQYADIFDKSVLKKLARRHYTGWGKLSAKLINGIRDKQSNKTILDYLIDDGKINRNFMQLINDDSLSFKETIQKAQVVGDTDDVKQVVQELPGSPAIKKGILQSIKIVDELVKVMGHNPDNIVIEMARENQTTNRGRSQSQQRLKKLQDSLKELGSNILNEEKPSYIEDKVENSHLQNDQLFLYYIQNGKDMYTGEELDIDHLSDYDIDHIIPQAFIKDDSIDNRVLTSSAKNRGKSDDVPSLDIVRERKADWIRLYKSKLISKRKFDNLTKAERGGLTEADKAGFIKRQLVETRQITKHVAQILDSRFNTKRDENDKVIRDVKVITLKSNLVSQFRKDFELYKVREINDYHHAHDAYLNAVVGTALLKKYPKLAPEFVYGEYKKYDIRKFITSSKDKATAKYFFYSNLMNFFKRIIRYSNGKIVVRPVVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 88 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKVDESFFQRLDDSFLVPDDKRDSKYPIFGNLVEEKTYHDEFPTIYHLRKYLADSQKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQAEFKKHFDLEEKAPLQFSKDTYDEDLENLLGQIGDDFADLFLVAKKLYDAILLSGILTVTDPSTKAPLSASMIERYENHQKDLAALKQFIKANLPEKYDEVFSDESKDGYAGYINGKTTQEAFYKYIKNLLSKFEGADYFLEKIEREDFLRKQRTFDNGSIPHQIHLQEMNAILRRQGEHYPFLKENKEKIQQILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKQTSKTILDYLIDDGKINRNFMQLINDDGLSFKEIIQKAQVVGKTDDVKQVVQELPGSPAIKKGILQSIKIVDELVKVMGHAPESIVIEMARENQTTARGKRNSQQRYKKIEEAVKNLASELDGNILKEYPTDNAQLQNERLFLYYLQNGRDMYTGKALDINNLSNYDIDHIVPQAFIKDDSIDNRVLTSSKDNRGKSDNVPSIEIVEKMKGFWQQLLNSKLISERKYNNLTKAERERGGLNELDKVGFIKRQLVETRQITKHVAQILDARFNTEVNEKNQKIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 89 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSTKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKDKRKVTEKDIIHYLHTVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLINDDGLSFKEIIQKAQVVGKTDDVKQVVQELPGSPAIKKGILQSIKIVDELVKVMGHAPESIVIEMARENQTTNQGKRNSQQRYKRIEEAIKNLSIDLNSKILKEYPTDNQALQNDRLFLYYLQNGKDMYTGKELDINQLSNYDIDHIVPQAFIKDDSLDNRVLTSSKDNRGKSDNVPSIEVVQKRKAFWQQLLDSKLISQRKFDNLTKAERGGLTEDDKAGFIKRQLVETRQITKHVAQILDARFNTEVDENGKRIRKVKIITLKSNLVSNFRKEFGLYKVREINDYHHAHDAYLNAVVAKAILKKYPKLEPEFVYGDYQKYDIKRYISRSKDPKDVEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 90 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKVYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFVKANLPEKYDEVFSDQSKDGYAGYIDGKTTQEAFYKYIKNLISKIEGADYFLEKIEREDFLRKQRTFDNGSIPHQIHLQEMHAILHNQGEYYPFLKDNKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKDKRKVTEKDIIQFLHNVDGYDGIELKGIEKQFNASLSTYHDLLKIIKDKEFMDDPKNEEILENIIHTLTIFEDREMIKQRLAQYDSLFDEKVIKALTRRHYTGWGKLSAKLINGIYDKQSRKTILDYLIDDDKINRNFMQLINDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDDNNKKIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRDKVEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 91 - protein, 1372 aa, synthetic construct
MTKPYSIGLDIGTNSVGWAVITDDYKVPSKKMKVLGNTSKKYVKKNLLGALLFESGITAEGRRLKRTARRRYTRRRNRILYLQEIFSTEMNKIDEGFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQNDLSALKQFIKRNLSEKYDEVFSDESKDGYAGYINGKTTQEAFYKYIKNLISKIEGADYFLEKIEREDFLRKQRTFDNGSIPHQIHLQEMNAILRHQGEYYPFLQENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIIHTLTIFEDREMIKQRLAQYDSLFDEKVIKALTRRHYTGWGKLSAKLINGICDKKTGKTILDYLIDDGEINRNFMQLIHDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEPLDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDSRFNTEVNDQGKKIRKVKIITLKSNLVSNFRKEFGLYKVREINDYHHAHDAYLNAVVAKAILKKYPKLEPEFVYGDYQKYDIKRYISKSRNPKTIDKATQKYFFYSNLLNFFKEEVHYADGTIVKRENVEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 92 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLAKEKTYHDEFPTIYHLRKYLADSQKKADLRLVYLALAHMIKYRGHFLIEGDFNSRNNDIKKNFQKFLDSYNAIFESDLSLENSKQLEEIVKDKISKSAKRERVLKLFPDEKSTGLFSEFLKLIVGNQAEFKKHFDLEEKAPLQFSKDTYDEDLENLLGQIGDGFADLFLVAKKLYDAILLSGILTVTDPSTKAPLSASMIERYENHQKDLAALKQFIQNNLQEKYDEVFSDQSKDGYAGYIDGKTTQEAFYKYIKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKKSGKTILDYLIDDGKINRNFMQLIHDDGLSFKEIIQKAQVVGKTDDVKQVVQELPGSPAIKKGILQSIKIVDELVKVMGHAPESIVIEMARENQTTNRGKRNSQQRYKRIENAVKNLASELNGNILKEYPTNNQALQNERLFLYYLQNGKDMYTGESLDINQLSSYDIDHIVPQAFIKDDSLDNRVLTSSKDNRGKSDNVPSLEIVEKMKGFWQQLLDSKLISERKFNNLTKAERGGLDERDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDVKRYISRSKDPKEIEKATEKYFFYSNLLNFFKEEVHYADGTIIKRENVEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 93 - protein, 1374 aa, synthetic construct
MNKPYSIGLDIGTNSVGWAVITDSYKVPSKKMKVLGNTSKKYVKKNLLGALLFESGITAEGRRLKRTARRRYTRRRNRILYLQEIFATEMAKIDESFFQRLDDSFLVPDDKRDSKYPIFGNLVEEKTYHDEFPTIYHLRKYLADSQKKADLRLVYLALAHMIKYRGHFLIEGDFNSRNNDIKKNFQDFLDSYNAIFESDLSLENNAQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFVKANLPEKYDEVFSDQSKDGYAGYIDGKTTQEAFYKYIKNLLSKFEGADYFLEKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGISDKQTGNTILDFLIDDKKINRNFMQLIHDDGLSFKEIIQKAQVVGKTDDVKQVVQELPGSPAIKKGILQSIKIVDELVKVMGHDPEHIVVEMARENQFTNQGRRNSQQRYKKIENAIKNLDSNLNSKILKEYPTNNQALQNDRLFLYYLQNGKDMYTGEALDINQLSNYDIDHIVPQAFIKDDSLDNRVLTSSKDNRGKSDNVPSIEVVEKMKAFWQQLLDSKLISERKYNNLTKAERERGGLNELDKVGFIKRQLVETRQITKHVAQILDARFNTEVNEKGKKIRKVKIITLKSNLVSNFRKEFGLYKVREINDYHHAHDAYLNAVVAKAILKKYPKLEPEFVYGDYQKYDIKRYISRSKDPKDVEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 94 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFATEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLATLKQFIKNNLSEKYDEVFSDQSKDGYAGYIDGKTTQEAFYKYIKNTLSKIEGSDYFLDKIEREDFLRKQRTFDNGSIPHQIHLQEMNAILHRQGEHYPFLKENKEKIEQILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSRKTILDYLIDDDKINRNFMQLIHDDGLSFKEIIQKAQVVGKTDDVKQVVQELPGSPAIKKGILQSIKIVDELVKVMGHAPESIVIEMARENQTTARGKKNSQQRYKRIEEALKNLAPGLDSNILKEHPTDNIQLQNDRLFLYYLQNGRDMYTGKPLDINQLSNYDIDHIVPQAFIKDDSIDNRVLTSSKDNRGKSDNVPSLEVVQKRKAFWQQLLDSKLISERKFNNLTKAERGGLDERDKVGFIKRQLVETRQITKHVAQILDARFNTEVNDKKQKIRKVKIITLKSNLVSNFRKEFGLYKVREINDYHHAHDAYLNAVVAKAILKKYPKLEPEFVYGDYQKYDLKRYISKSKDPKEIEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 95 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMSKIDEGFFQRLDDSFLVPDDKRDSKYPIFGNLVEEKVYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIQRYEDHQEDLKKLKEFIRRNIPEKYDEVFADSSKNGYAGYIDGKTTQEEFYKYIKEKLNNIKGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKKTGKTILDYLIDDGKINRNFMQLIHDDGLSFKEIIQKAQVVGKTDDVKQVVQELPGSPAIKKGILQSIKIVDELVKVMGHAPESIVIEMARENQTTNQGKRNSQQRYKRIEDGVKNLASDLNGNILKEYPTDNQALQNDRLFLYYLQNGKDMYTGEELDINQLSNYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEKDENGKKIRKVKIITLKSNLVSNFRKEFGLYKVREINDYHHAHDAYLNAVVAKAILKKYPKLEPEFVYGDYQKYDVKRYISRSKDPKEIEKATQKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 96 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSQKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFNLEEKAPLHFSKDTYDEDLENLLGQIGDDFADLFLVAKKLYDAILLSGILTVTDPSTKAPLSASMIDRYENHQKDLAALKQFIQNNLQEKYDEVFSDESKDGYAGYIDGKTTQEAFYKYIKNLISKFEGADYFLEKIEREDFLRKQRTFDNGSIPHQIHLQEMNAILHHQGEYYPFLKENSEKIQQILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGISDKQTGNTILDYLIDDDKINRNFMQLIHDDGLSFKEIIQKAQVVGKTDDVKQVVQELPGSPAIKKGILQSIKIVDELVKVMGHAPESIVIEMARENQTTNQGRRNSQQRYKLIEDGVKNLASDLNGNILKEYPTNNQALQNDRLFLYYLQNGKDMYTGESLDINQLSSYDIDHIVPQAFIKDDSLDNRVLTSSKDNRGKSDNVPSLEVVQKRKAFWQQLLDSKLISERKFNNLTKAERGGLDERDKVGFIRRQLVETRQITKHVAQILDARFNVEVNDKKQKIRNVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 97 - protein, 1372 aa, synthetic construct
MTKPYSIGLDIGTNSVGWAVITDDYKVPSKKMKVLGNTSKKYVKKNLLGALLFESGITAEGRRLKRTARRRYTRRRNRILYLQEIFSTEMNKIDESFFQRLDDSFLVPDDKRDSKYPIFGNLVEEKTYHDEFPTIYHLRKYLADSQKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDYADLFLVAKKLYDAILLSGILTATNPITKAPLSASMIERYDKHHKDLVLLKELVRRNLPEKYDEVFSDQSKDGYAGYIDGKTTQEAFYKYIKNTLNKIEGADYFLDKIEREDFLRKQRTFDNGSIPHQIHLQEMNAILRRQGEHYPFLKENKEKIQQILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLINDDGLSFKEIIQKAQVVGKTDDVKQVVQELPGSPAIKKGILQSIKIVDELVKVMGHDPESIVIEMARENQTTNQGRRNSQQRYKKIENAIKNLDSELNSKILKEYPTDNQALQNERLFLYYLQNGKDMYTDEELDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVNEKKQKIRTVKIITLKSNLVSNFRKEFGLYKVREINDYHHAHDAYLNAVVAKAILKKYPKLEPEFVYGDYQKYDIKRYISKSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 98 - protein, 1366 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEGDLALLKAYIRNISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIEYLHAIDGYDGIELKGIEKQFNSSLATYHDLLNIINDKEFLDDSSNEAIIEEIIHTLTIFEDREMIKQRLSKFENIFDKSVLKKLSRRHYTGWGKLSAKLINGIRDEKSGKTILDYLIDDGISNRNFMQLIHDDTLSFKKKIQKAQIIGDQDNIKQVVQSLPGSPAIKKGILQSIKIVDELVKVMGRNPESIVVEMARENQYTNQGKSNSQQRLKRLEEAIKELGSNVLKKENPVLKETKIDNQALQNERLYLYYLQNGKDMYTGDDLDIDRLSNYDIDHIIPQAFLKDNSIDNKVLVSSASNRGKSDDVPSLDVVKKRKTFWHQLLKSKLISQRKFDNLTKAERGGLTPEDKAGFIRRQLVETRQITKHVARLLDERFNVKRDDNDKLIRNVKIITLKSSLVSQFRKDFELYKVREINDFHHAHDAYLNAVVAKAILTKYPKLEPEFVYGDYPKYNSFRERKSATQKVFFYSNIMNLFKKEVRLADGTIVVRPVIEYSKDTGEVAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 99 - protein, 1373 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFAAEMNKIDESFFQRLDDSFLVPDDKRDSKYPIFGNLVEEKAYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLALLKQFIKQNLSQEKYDEVFKDESKNGYAGYIENGVKQDEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKKTGKTILDYLIDDGEINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEPLDINQLSSYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVNEKGQKIRKVKIITLKSNLVSNFRKEFGLYKVREINDYHHAHDAYLNAVVAKAILKKYPKLEPEFVYGDYQKYDIKRYISRSKDPKDVEKATQKYFFYSNLLNFFKEEVHYADGTIIKRENIEYSKDTGEVAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 100 - protein, 1372 aa, synthetic construct
MKKPYSIGLDIGTNSVGWAVVTDDYKVPAKKMKVLGNTDKSHIKKNLLGALLFDSGETAEGRRLKRTARRRYTRRRNRILYLQEIFATEMAKVDESFFQRLDDSFLVPDDKRDSKYPIFGNLAQEKTYHDEFPTIYHLRKYLADSQKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYINGKTTQEAFYKYIKNLLSKLEGSDYFLDKIEREDFLRKQRTFDNGSIPHQIHLQEMNAIIRRQGEHYPFLQENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHFLHNVDGYDGIELKGIEKQFNASLSTYHDLLKIIKDKEFMDDPKNEEILENIVHTLTIFEDREMIKQRLAQYDTLFDEKVIKALTRRHYTGWGKLSAKLINGICDKQTGDTILDFLIDDDKINRNFMQLINDDGLSFKEIIQKAQVVGKTDDVKQVVQELPGSPAIKKGILQSIKIVDELVKVMGHNPESIVIEMARENQTTNQGRRNSQQRYKKIEEAIKNLDSNLNSKILKEYPTENQALQNDRLFLYYLQNGKDMYTDEELDINQLSNYDIDHIVPQAFIKDDSLDNRVLTSSKDNRGKSDNVPSIEIVQKRKGFWQQLLDSKLISERKFNNLTKAERGGLDERDKVGFIKRQLVETRQITKHVAQILDARFNTEVNEKKQKIRTVKIITLKSNLVSNFRKEFGLYKVREINDYHHAHDAYLNAVVAKAILKKYPKLEPEFVYGDYQKYDLKRYISRSKDPKDVEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 101 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLSEKYDEVFSDQSKDGYAGYIDGKTTQEAFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLIHDDGLSFKEIIQKAQVVGKTDDVKQVVQELPGSPAIKKGILQSIKIVDELVKVMGHAPESIVIEMARENQTTNQGRRNSQQRYKLIEDGVKNLASDLNGNILKEYPTNNQALQNERLFLYYLQNGKDMYTGEALDINQLSNYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDETGKKIRKVKIITLKSNLVSNFRKEFGLYKVREINDYHHAHDAYLNAVVAKAILKKYPKLEPEFVYGDYQKYDIKRYISKSKDPKDIEKATEKYFFYSNLLNFFKEKVTYADGTITKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 102 - protein, 1372 aa, synthetic construct
MNKPYSIGLDIGTNSVGWAVITDNYKVPSKKMKVLGNTSKKYVKKNLLGALLFESGITAEGRRLKRTARRRYTRRRNRILYLQEIFIDGMNEIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQAEFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLIDGIYDKQSRKTILDYLIDDDKINRNFMQLINDDGLSFKEIIQKAQVVGKTDDVKQVVQELPGSPAIKKGILQSIKIVDELVKVMGHDPESIVIEMARENQTTNQGRRNSQQRYKKIENAIKNLDSNLNSKILKEYPTNNQALQNDRLFLYYLQNGKDMYKDQELDINQLSNYDIDHIVPQAFIKDDSLDNRVLTSSKDNRGKSDNVPSLEVVQKRKGFWQQLLDSKLISERKFNNLTKAERGGLDERDKVGFIKRQLVETRQITKHVAQILDARFNTEVNENNQRIRKVKIITLKSNLVSNFRKEFGLYKVREINDYHHAHDAYLNAVVAKAILKKYPKLEPEFVYGDYQKYDVKRYISRSKDPKDIEKATEKYFFYSNLLNFFKEEVHYADGTIVKRENVEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 103 - protein, 1374 aa, synthetic construct
MNKPYSIGLDIGTNSVGWAVITDSYKVPSKKMKVLGNTSKKYVKKNLLGALLFESGITAEGRRLKRTARRRYTRRRNRILYLQEIFSTEMNKIDESFFQRLDDSFLVPDDKRDSKYPIFGNLAQEKTYHEEFPTIYHLRKYLADSQKKADLRLVYLALAHMIKYRGHFLIEGDFNSRNNDIKKNFEKFLDSYNAIFESDLSLENSAQVEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLAALKQFIKSNLSEKYDEVFSDQSKDGYAGYINGKTTQEAFYKYIKNLLSKFEGADYFLEKIEREDFLRKQRTFDNGSIPHQIHLQEMHAILHRQGEYYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDFLIDDDKINRNFMQLINDDGLSFKEIIQKAQVVGKTDDVKQVVQELPGSPAIKKGILQSIKIVDELVKVMGHAPESIVIEMARENQTTNQGRRNSQQRYKKIENAIKNLDSNLNSKILKEYPTDNQALQNDRLFLYYLQNGKDMYTDEELDINQLSNYDIDHIVPQAFIKDDSLDNRVLTSSKDNRGKSDNVPSLEVVQKRKAFWQQLLDSKLISERKYNNLTKAERERGGLNELDKVGFIKRQLVETRQITKHVAQILDARFNTEVNEKKQKIRTVKIITLKSNLVSNFRKEFGLYKVREINDYHHAHDAYLNAVVAKAILKKYPKLEPEFVYGDYQKYDIKRYISKSKDPKEIDKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 104 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLAALKQFIKSNLSEKYDEVFSDQSKDGYAGYIDGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKAFMDDAKNEEILENIVHTLTIFEDREMIKQRLAQYDSLFDEKVIKALTRRHYTGWGKLSAKLINGICDKQTGNTILDYLIDDDKINRNFMQLINDDGLSFKEIIQKAQVVGKTDDLKQVVQNLPGSPAIKKGILQSIKLVDELVKVMGSDPESIVIEMARENQTTNQGRRNSQQRYKLLEDGVKNLASDLNGNILKEYPTDNQALQNERLFLYYLQNGKDMYTGEALDINQLSSCDIDHIIPQAFIKDDSLDNRVLTSSKDNRGKSDNVPSIEIVQKMKGFWQQLLDSKLISERKFNNLTKAERGGLDERDKVGFIRRQLVETRQITKHVAQILDARFNTEVNEKKQKIRKVKIITLKSNLVSNFRKEFGLYKVREINDYHHAHDAYLNAVVAKAILKKYPKLEPEFVYGDYQKYDIKRYISRSKDPKTIEKATQKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 105 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSTKKADLRLVYLALAHMIKYRGHFLIEGEFNSKNNDIKKNFQNFLDSYNAIFESDLSLENSAQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHFLHNVDGYDGIELKGIEKQFNASLSTYHDLLKIIKDKEFMDDPKNQEILENIVHTLTIFEDREMIKQRLAQYDSLFDEKVIKALTRRHYTGWGKLSAKLINGICDKQTGKTILDYLIDDGEINRNFMQLIHDDGLSFKEIIQKAQVVGKTDDVKQVVQELPGSPAIKKGILQSIKIVDELVKVMGHAPESIVIEMARENQTTARGKKNSQQRYKRIEDAIKNLAPELDSKILKEYPTDNQALQNDRLFLYYLQNGKDMYTGNPLDINRLSDYDIDHIIPQAFIKDDSIDNRVLTSSKDNRGKSDNVPSLEVVEKMKGFWQQLLKSKLISQRKFDNLTKAERGGLTEHDKAGFIKRQLVETRQITKHVAQILDARFNTEVNDKKQKIRNVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 106 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSKNNDIKKNYQNFLDSYNAIFESDLSLENNAQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFVRSNLPEKYDEVFSDQSKDGYAGYIDGKTTQEAFYKYIKNLLSKFEGSDYFLDKIEREDFLRKQRTFDNGSIPHQIHLQEMKAIIHRQGEHYPFLQENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLINDDGLSFKEIIQKAQVVGETDDLKQVVQNLPGSPAIKKGILQSIKIVDELVKVMGSDPESIVIEMARENQTTNQGRRNSQQRYKKIEDAIKNLDSNLNSKILKEYPTDNQALQNDRLFLYYLQNGKDMYTGEELDINQLSNYDIDHIIPQAFIKDDSLDNRVLTSSKDNRGKSDNVPSIEVVEKMKGFWQQLLNSKLISEHKFNNLTKAERGGLDERDKVGFIKRQLVETRQITKHVAQILDARFNTEVNENGKKIRKVKIITLKSNLVSNFRKEFGLYKVREINDYHHAHDAYLNAVVAKAILKKYPKLEPEFVYGDYQKYDIKRYISRSKDPKDVEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 107 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKAYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLAALKQFIKANLPEKYDEVFSDQSKDGYAGYIDGKTTQEAFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKKSGKTILDYLIDDDKINRNFMQLINDDGLSFKEIIQKAQVVGKTDDLKQVVQELPGSPAIKKGILQSIKIVDELVKVMGHNPENIVVEMARENQFTNQGRRNSQQRYKKIKEAIKNLDSNLNSKILKEYPTDNQALQNDRLFLYYLQNGKDMYTGEALDINQLSNYDIDHIIPQAFIKDDSLDNRVLTSSKDNRGKSDNVPSIEVVEKMKAFWQQLLDSKLISERKFNNLTKAERERGGLNELDKVGFIKRQLVETRQITKHVAQILDARFNTEVNEKNQKIREVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 108 - protein, 1372 aa, synthetic construct
MKKPYSIGLDIGTNSVGWAVVDDDYKVPAKKMRVFGDTDKGHIKKNLLGTLLFDSGETAESRRLKRTARRRYTRRRNRILYLQEIFAEEMSKVDDSFFHRLEESFLTDDDKNFDSHPIFGNKAEEDAYHQKFPTIYHLRKHLADSTEKADLRLVYLALAHMIKFRGHFLIEGQLNAENTDVQTLFNDFVEVYDKTVEESHLAEITVDALSILTEKVSKSRRLENLIKHYPTEKKNTLFGNLVALALGLQPNFKTNFKLSEDAKLQFSKDTYEEDLEELLGKIGDDYADLFTSAKNLYDAILLSGILTVDDNSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQAKIEKILTFRIPYYVGPLARKNSRFAWAEYHSDEPITPWNFDEVVDKEKSAEKFITRMTMNDLYLPEEKVLPKHSHVYETYTVYNELTKIKYVNEQGESFFFDANMKQEIFDHVFKENRKVSKEKILNYLNKEFPEYRIQDLIGLDKENKSFNASLGTYHDLKKILDKSFLDDKTNEQIIEDIVLTLTLFEDRDMIRERLQKYSDIFTKQQLKKLERRHYTGWGRLSYKLINGIRNKENNKTILDFLIDDGRANRNFMQLINDDSLSFKTIIQEAQVVGDVDDIEAVVHDLPGSPAIKKGILQSVKIVDELVKVMGHNPDNIVIEMARENQTTNRGRSQSQQRLKKLQESLKELGSNILNEEKPSYIEDKVENSHLQNDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTEADKAGFIKRQLVETRQITKHVAQILDGRFNTKRDENDKVIRDVKVITLKSNLVSQFRKDFGFYKVREINDYHHAHDAYLNAVVGTALLKKYPKLAPEFVYGEYKKYDIRKFITNSSDKATAKYFFYSNLMNFFKRVIRYSNGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 109 - protein, 1373 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMSKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRILKLFPGEKNSGIFSEFLKLIVGNQADFKKYFNLDDQASLHFSKESYDEDLETLLGHIGDDYSDVFLKAKKLYDAILLSGILTVTDNETEAPLSSAMIMRYKEHEEDLALLKAYIRNISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLSTYHDLLNIINDKEFLDDASNEAIIEEIIHTLTIFEDREMIKQRLSKFENIFDKSVLKKLSRRHYTGWGKLSAKLINGIRDEKSGKTILDYLIDDGISNRNFMQLIHDDTLSFKKKIQKAQIIGDQDNIKQVVQSLPGSPAIKKGILQSIKIVDELVKVMGRNPESIVVEMARENQYTNQGKSNSQQRLKRLEESLKELGSKILKENVPAKLSKIDNNALQNERLYLYYLQNGKDMYTGKDLDIDRLSNYDIDHIIPQAFLKDNSIDNKVLVSSASNRGKSDDVPSLDVVKKRKGFWHQLLKSKLISQRKFDNLTKAERGGLTEDDKAGFIKRQLVETRQITKHVAQILDSRFNTKRDDNDKVIRDVKIITLKSNLVSQFRKEFGLYKVREINDYHHAHDAYLNAVVATAILKKYPKLEPEFVYGDYQKYDIKKYLASKDDSSLGKATAKMFFYSNLMNFFKKKVRLSDGTVLIRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 110 - protein, 1372 aa, synthetic construct
MNKPYSIGLDIGTNSVGWAVITDSYKVPSKKMKVLGNTSKKYVKKNLLGALLFESGITAEGRRLKRTARRRYTRRRNRILYLQEIFSTEMNKIDEGFFQRLDDSFLVPDDKRDSKYPIFGNLVEEKTYHDEFPTIYHLRKYLADSSKKADLRLVYLALAHMIKYRGHFLIEGDFNSRNNDIKKNFSKFLDSYNAIFESDLSLENSEQVEEIVKDKISKSAKRERVLKLFPDEKSTGLFSEFLKLIVGNQADFKKHFDLEEKAPLQFSKDTYEEDLESLLGQIGDIYADLFVVAKKLYDAILLAGILSVKDPSTKAPLSASMIERYDNHQNDLSALKQFIRRNLSEKYDEVFSDESKDGYAGYINGKTTQEAFYKYIKNLLSKLEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKKTGKTILDYLIDDDKINRNFMQLIHDDGLSFKEIIQKAQVVGKTDDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSSYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENGKKIRKVKIITLKSNLVSNFRKEFRLYKVREINDYHHAHDAYLNAVVAKAILKKYPKLEPEFVYGDYQKYDIKRYISRSKDPKDIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 111 - protein, 1372 aa, synthetic construct
MTKPYSIGLDIGTNSVGWAVISDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDKFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKDLLNNVEGADYFLEKIEREDFLRKQRTFDNGTIPYQIHLQEMKAILHNQGEYYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKEIIQKAQVVGKTDDVKQVVQELPGSPAIKKGILQSIKLVDELVKVMGDDPESIVIEMARENQTTARGKKNSQQRYKRIEDALKNLAPGLDSNILKEHPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISEHKFNNLTKAERGGLDERDKVGFIKRQLVETRQITKHVAQILDARFNTEVNDKNQKIRSVKIITLKSNLVSNFRKEFGLYKVREINDYHHAHDAYLNAVVAKAILKKYPKLEPEFVYGDYQKYDLKRYISKSKEPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 112 - protein, 1372 aa, synthetic construct
MNKPYSIGLDIGTNSVGWAVITDSYKVPSKKMKVLGNTSKKYVKKNLLGALLFESGITAEGRRLKRTARRRYTRRRNRILYLQEIFSTEMAKVDESFFQRLDDSFLVPDDKRDSKYPIFGNLVEEKTYHEEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPNTKAPLSASMIERYENHEEDLAALKQFIKNNLPEKYDEVFSDQSKDGYAGYINGKTTQEAFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGNTILDYLIDDDKINRNFMQLINDDGLSFKEIIQKAQVVGKTNDVKQVVQELPGSPAIKKGILQSIKLVDELVKVMGHEPEQIVIEMARENQTTNQGKRNSQQRYKRIEDGVKNLASDLNGNILKEYPTDNQALQNDRLFLYYLQNGKDMYTGEPLDINQLSNYDIDHIVPQAFIKDDSLDNRVLTSSKDNRGKSDNVPSIEVVQKRKAFWQQLLDSKLISERKFNNLTKAERGGLDERDKVGFIRRQLVETRQITKHVAQILDARFNTEVDDTGKRIRKVKIITLKSNLVSNFRKEFGLYKVREINDYHHAHDAYLNAVVAKAILKKYPKLEPEFVYGDYQKYDVKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 113 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKAKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 114 - protein, 1372 aa, synthetic construct
MKKPYSIGLDIGTNSVGWAVITDDYKVPSKKMKVLGNTSKKYVKKNLLGALLFESGITAEGRRLKRTARRRYTRRRNRILYLQEIFETGMKEIDESFFQRLDDSFLVPDDKRDSKYPIFGNLAQEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNTLSKIEGSDYFLDKIEREDFLRKQRTFDNGSIPHQIHLQEMNAIIRRQGEHYPFLQENKEKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIRDKDFMDDPKNEEILENIVHTLTIFEDREMIKQRLAQYDSIFDEKVIKALARRHYTGWGRLSAKLINGIRDKQSKKTILDYLIDDDKINRNFMQLINDDGLSFKEIIQKAQVVGKTDDVKQVVQELPGSPAIKKGILQSIKIVDELVKVMGYDPEQIVIEMARENQTTNQGRRNSQQRYKLIEDGVKNLASDLNGNILKEYPTDNQALQNDRLFLYYLQNGKDMYTGEPLDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVNEKKQKIRSVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 115 - protein, 1372 aa, synthetic construct
MTKPYSIGLDIGTNSVGWAVISDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKVYHDEFPTIYHLRKYLADSQKKADLRLVYLALAHMIKYRGHFLIEGDFNSRNNDIKKNFQNFLDSYNAIFESDLSLENSKQLEEIVKDKISKSAKRERVLSLFPDEKSTGLFSEFLKLIVGNQADFKKHFELEEKAPLQFSKDTYDEDLENLLGQIGDDFADLFLVAKKLYDAILLSGILTVTDPSTKAPLSASMIERYENHQKDLAQLKQFVKTNLPEKYDEVFSDQSKDGYAGYIDGKTTQEAFYKYIKETLNKVEGADYFLDKIERENFLRKQRTFDNGSIPHQIHLQEMNAILHRQGEHYPFLKENKEKIEKILTFRIPYYVGPLARGNRDFAWLTRNSDQAIRPWNFEEVVDQASSAEEFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIIHTLTIFEDREMIKQRLAQYDTLFDEKVIKALTRRHYTGWGKLSAKLINGICDKQTGDTILDFLIDDDKINRNFMQLINDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEPLDINQLSSYDIDHIVPQAFIKDDSLDNRVLTSSKDNRGKSDNVPSIEVVQKRKAFWQQLLDSKLISERKFNNLTKAERGGLDERDKVGFIRRQLVETRQITKHVAQILDARFNTEVDSKGKKIRKVKIITLKSNLVSNFRKEFGLYKVREINDYHHAHDAYLNAVVAKAILKKYPKLEPEFVYGDYQKYDVKRYISRSKDPKEVEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 116 - protein, 1365 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSTKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFKKYFNLDEKAPLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTSQEDFYVHLKKLLTGLEGADYFLEKINREDLLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGVEDQFNASLSTYHDLLNIINDKEFLDDSSNEAIIEEIIHTLTIFEDREMIKQRLSKYEDIFGKSVLKKLSRRHYTGWGKLSAKLINGIRDEKSGKTILDYLIDDGISNRNFMQLIHDDTLSFKKKIQKAQIIGDQDNIKQVVQSLPGSPAIKKGILQSIKIVDELVKVMGRRPESIVVEMARENQYTNQGKSNSQQRLKRLEESLKELGSKILKENVPAKLSKIDNNALQNERLYLYYLQNGKDMYTGDDLDIDRLSNYDIDHIIPQAFLKDNSIDNKVLVSSASNRGKSDDVPSLDVVKKRKTFWHQLLKSQLISQRKFDNLTKAERGGLSPEDKAGFIQRQLVETRQITKHVARLLDERFNNEKDEDNKALRTVKIITLKSSLVSQFRKDFELYKVREINDFHHAHDAYLNAVVATALLKKYPKLEPEFVYGDYPKYNSYKSRKSATEKVLFYSNIMNFFKRLVRLSDGRVLIRPVIEYSKDTGEVAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 117 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKAYHDEFPTIYHLRKYLADSSKKADLRLVYLALAHMIKYRGHFLIEGDFNSRNNDIKKQFQDFLDSYNAIFESSLSLEQSEQVEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLEKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKKTGNTILDYLIDDDKINRNFMQLINDDSLSFKDIIQKAQVVGKTDDVKQVVQELPGSPAIKKGILQSIKIVDELVKVMGHAPESIVIEMARENQTTNQGRRNSQQRYKRIEEAIKNLSVDLDSKILKEYPTDNQALQNDRLFLYYLQNGKDMYTGEPLDINQLSNYDIDHIVPQAFIKDDSLDNRVLTSSKDNRGKSDNVPSLEIVQKRKAFWQQLLDSKLISERKFNNLTKAERGGLDERDKVGFIRRQLVETRQITKHVAQILDARFNTEVNDKGQKIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENVEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 118 - protein, 1372 aa, synthetic construct
MNKPYSIGLDIGTNSVGWAVITDSYKVPSKKMKVLGNTSKKYVKKNLLGALLFESGITAEGRRLKRTARRRYTRRRNRILYLQEIFGTEMNEIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQAEFKKHFDLEEKAPLQFSKDTYDEDLENLLGQIGDDFADLFLVAKKLYDAILLSGILTVTDPSTKAPLSASMIERYENHQKDLAALKQFVKNNLPEKYDEVFSDQSKDGYAGYIDGKTTQEAFYKYIKNLLSKFEGADYFLEKIEREDFLRKQRTFDNGSIPHQIHLQEMQAILHRQGEYYPFLKENREKIEKILTFRIPYYVGPLARGNRDFAWLTRNSDQAIRPWNFEEVVDQASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDAKNEEILENIVHTLTIFEDREMIKQRLAQYDSLFDEKVIKALTRRHYTGWGKLSAKLINGICDKQTGDTILDYLIDDDKINRNFMQLINDDGLSFKEIIQKAQVFGKTDDVKQVVQELPGSPAIKKGILQSIKIVDELVKVMGHAPESIVIEMARENQTTNQGKRNSQQRYKRIEDGVKNLASDLNGNILKEYPTNNQALQNDRLFLYYLQNGKDMYTGESLDINQLSSYDIDHIIPQAFIKDDSIDNRVLTSSKDNRGKSDNVPSLEVVQKRKAFWQQLLDSKLISERKFNNLTKAERGGLDERDKVGFIKRQLVETRQITKHVAQILDARFNTEVDENNQKIRKVKIITLKSNLVSNFRKEFGLYKVREINDYHHAHDAYLNAVVAKAILKKYPKLEPEFVYGDYQKYDLKRYISKSKDPKDIEKATEKFFFYSNLLNFFKEKVTYADGTIKKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 119 - protein, 1372 aa, synthetic construct
MTKPYSIGLDIGTNSVGWAVITDDYKVPSKKMKVLGNTSKKYVKKNLLGALLFESGITAEGRRLKRTARRRYTRRRNRILYLQEIFSTEMNKIDESFFQRLDDSFLVPDDKRDSKYPIFGNLAQEKTYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLAALKQFVRTNLPEKYDEVFSDQSKDGYAGYIDGKTTQEAFYKYLKKLLTGLEGADYFLEKIEREDFLRKQRTFDNGTIPYQLHLEELKAIIHNQGEYYPFLQENKEKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKEHPTDNIQLQNDRLFLYYLQNGKDMYTGEPLDINQLSSYDIDHIVPQAFIKDDSLDNRVLTSSKDNRGKSDNVPSLEVVQKRKAFWQQLLDSKLISERKFNNLTKAERGGLDERDKVGFIRRQLVETRQITKHVAQILDARFNTEVNEKGKKIRKVKIITLKSNLVSNFRKEFGLYKVREINDYHHAHDAYLNAVVAKAILKKYPKLEPEFVYGDYQKYDLKRYISKSKDPKEVEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 120 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKVDESFFQRLDDSFLVPDDKRDSKYPIFGNLVQEKTYHDEFPTIYHLRKYLADSSKKADLRLVYLALAHMIKYRGHFLIEGDFNSKNNDIKKNFQEFLDSYNAIFESDLSLENNAQVEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLAALKQFVKANLPEKYDEVFSDQSKDGYAGYIDGKTTQEAFYKYIKNLLAKFEGADYFLEKIEREDFLRKQRTFDNGVIPYQVHLTEMRAILHRQGEYYPFLKENREKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKDFMDDPKNEEILENIVHTLTIFEDREMIKQRLAQYDSLFDEKVIKALTRRHYTGWGKLSAKLINGICDKQTGDTILDYLIDDDKINRNFMQLINDDGLSFKEIIQKAQVVGKTDDVKQVVQELPGSPAIKKGILQSIKIVDELVKVMGHAPESIVIEMARENQTTNQGKRNSQQRYKKIEDAIKNLDSNLNSKILKEYPTNNQALQNDRLFLYYLQNGKDMYTGEELDINQLSNYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENGKRIRKVKIITLKSNLVSNFRKEFGLYKVREINDYHHAHDAYLNAVVAKAILKKYPKLEPEFVYGDYQKYDIKRYISRSKDPKEVEKATEKYFFYSNLLNFFKEEVTYADGTIKKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 121 - protein, 1372 aa, synthetic construct
MTKPYSIGLDIGTNSVGWAVITDNYKVPSKKMKVLGNTSKKYVKKNLLGALLFESGITAEGRRLKRTARRRYTRRRNRILYLQEIFSTEMSKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQNFLDSYNAIFESDLSLENSEQLEEIVKDKISKSAKRERVLKLFPDEKSTGLFSEFLKLIVGNQAEFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDYLIDDDKINRNFMQLINDDGLSFKEIIQKAQVVGKTDDVKQVVQELPGSPAIKKGILQSIKIVDELVKVMGHAPESIVIEMARENQTTNQGKRNSQQRYKRIEDGIKNLASDLNGNILKEYPTDNQALQNDRLFLYYLQNGKDMYTGEPLDINQLSNYDIDHIVPQAFIKDDSLDNRVLTSSKDNRGKSDNVPSLEVVQKRKAFWQQLLDSQLISQRKFDNLTKAERGGLTDHDKAGFIKRQLVETRQITKHVAQILDARFNTEVTEKDKKIRNVKIITLKSNLVSNFRKEFGLYKVREINDYHHAHDAYLNAVVAKAILKKYPKLEPEFVYGDYQKYDIKRYISRSKDPKDIDKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 122 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKSNLSEKYDEVFSDQSKDGYAGYIDGKTTQEAFYKYIKNLLSKLEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKDFMDDPKNEEILENIVHTLTIFEDREMIKQRLAQYDSLFDEKVIKALTRRHYTGWGKLSAKLIDGIYDKQSRKTILDYLIDDGEINRNFMQLIHDDGLSFKEIIQKAQVVGETDNLKQVVQELPGSPAIKKGILQSIKIVDELVKVMGHAPESIVIEMARENQTTARGKKNSQQRYKRIEDALKNLAPGLDSNILKENPTDNVQLQNDRLFLYYLQNGKDMYTGEPLDINQLSSYDIDHIVPQAFIKDDSLDNRVLTSSKDNRGKSDNVPSLEVVQKRKAFWQQLLDSKLISQRKFDNLTKAERGGLTENDKAGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 123 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAEIDESFFQRLDDSFLVPDDKRDSKYPIFGNLVKEKTYHDEFPTIYHLRKYLADSTKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAQLKQFVKTNLPEKYDEVFSDQSKDGYAGYINGKTTQEAFYKYIKNLLSKLEGADYFLDKIEREDFLRKQRTFDNGSIPHQIHLQEMNAILHRQGEHYPFLKENKEKIQQLLTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKDFMDDPKNEEILENIVHTLTIFEDREMIKQRLAQYDTLFDEKVIKALARRHYTGWGKLSAKLINGIYDKQSKKTILDYLIDDDKINRNFMQLINDDGLSFKDIIQKAQVVGKTDDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVNEKKQKIRNVKIITLKSNLVSNFRKEFGLYKVREINDYHHAHDAYLNAVVAKAILKKYPKLEPEFVYGDYQKYDIKRYISRSKDPKDIEKATQKYFFYSNLLNFFKEEVHYADGTIVKRENVEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 124 - protein, 1374 aa, synthetic construct
MKKPYSIGLDIGTNSVGWAVITDDYKVPSKKMKVLGNTSKKYVKKNLLGALLFESGITAEGRRLKRTARRRYTRRRNRILYLQEIFSTEMSKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDPKNEEILENIIHTLTIFEDREMIKQRLAQYDSLFDEKVIKALTRRHYTGWGKLSAKLINGIRDDKSGNTILDYLIDDDKINRNFMQLIHDDGLSFKEIIQKAQVFGKTDDVKQVVQELPGSPAIKKGILQSIKIVDELVKVMGHAPESIVIEMARENQTTNQGKRNSQQRYKRIEEGIKNLASELNGNILKEYPTNNQALQNERLFLYYLQNGRDMYTGKSLDINQLSNYDIDHIIPQAFIKDDSLDNRVLTSSKDNRGKSDNVPSIEVVEKMKAFWQQLLDSKLISERKFNNLTKAERERGGLNELDKVGFIKRQLVETRQITKHVAQILDARFNTEVNEKKQKIREVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 125 - protein, 1371 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKVDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQAEFKKHFDLEEKAPLQFSKDTYDEDLENLLGQIGDDFADLFLVAKKLYDAILLSGILTVTDPSTKAPLSASMIERYENHQKDLATLKQFIKNNLSEKYDEVFSDQSKDGYAGYIDGKTTQEAFYKYIKNLLSKLEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLIHDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEPLDINQLSSYDIDHIVPQAFIKDDSLDNRVLTSSKDNRGKSDNVPSLEVVQKRKGFWQQLLDSKLISERKFNNLTKAERGGLDERDKVGFIKRQLVETRQITKHVAQILDARFNTEVNEKNQKIRTVKIITLKSNLVSNFRKEFRLYKVREINDYHHAHDAYLNAVVAKAILKKYPKLEPEFVYGDYQKYDVRRYLSSKDSKDFGKATAKMFFYSNLLNFFKKEVRLADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 126 - protein, 1372 aa, synthetic construct
MKKPYSIGLDIGTNSVGWAVVTDDYKVPAKKMKVLGNTDKSHIKKNLLGALLFESGETAEGRRLKRTARRRYTRRRNRILYLQEIFATEMNKIDESFFQRLDDSFLVPDDKRDSKYPIFGNLAQEKTYHEKFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLATLKQFIKNNLSEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDPKNEEILENIIHTLTIFEDREMIKQRLAQYDSIFDEKVIKALTRRHYTGWGKLSAKLINGIYDKQSKKTILDYLIDDDKINRNFMQLINDDGLSFKEIIQKAQVVGKTDDVKQVVQELPGSPAIKKGILQSIKIVDELVKVMGGDPESIVVEMARENQFTNQGRRNSQQRYKKIKEAIKNLDSDLNSKILKEYPTDNQALQNDRLFLYYLQNGKDMYTGEALDINQLSNYDIDHIIPQAFIKDDSLDNRVLTSSKDNRGKSDNVPSLEIVEKMKGFWRQLLDSKLISQRKFDNLTKAERGGLTEHDKAGFIKRQLVETRQITKHVAQILDARFNTEVNDKKQKIRNVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 127 - protein, 1365 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKAYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRILKLFPGEKNSGIFSEFLKLIVGNQADFKKYFNLDEKAPLHFSKESYDEDLETLLGHIGDDYSDVFLKAKKLYDAILLSGILTVTDNETEAPLSSAMIMRYKEHEEDLALLKAYIRNISLETYNEVFKDDTKNGYAGYIDGKTNQEDFYVYLKKLLTGLEGADYFLEKINREDLLRKQRTFDNGSIPHQIHLQEMHAILRKQEKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGKTILDYLIDDGVSNRNFMQLIHDDTLSFKKKIQKAQIIGDQDNIKQVVQSLPGSPAIKKGILQSIKIVDELVKVMGRNPESIVVEMARENQYTNQGKSNSQQRLKRLEESLKELGSKILKENVPAKLSKIDNNALQNERLYLYYLQNGKDMYTGDDLDIDRLSNYDIDHIIPQAFLKDNSIDNKVLVSSASNRGKSDDVPSLDVVKKRKTFWHQLLKSKLISQRKFDNLTKAERGGLTPEDKAGFIQRQLVETRQITKHVAQLLDNRFNEKRDEDKKVIRKVNIVLLKSSLVSQFRKDFELYKVREINDFHHAHDAYLNAVVATALLKKYPKLEPEFVYGEYSKFKVSKDIDKATEKYFFYSNLLNFFKEKVLYADGTVVFRKNVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 128 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNIQEKYDEVFSDQSKDGYAGYINGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEVVDQASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIIHTLTIFEDREMIKQRLAQYDSIFDEKVIKALTRRHYTGWGKLSAKLINGIYDKQSKKTILDYLIDDDKINRNFMQLINDDGLSFKEIIQKAQVVGKTDDVKQVVQELPGSPAIKKGILQSIKLVDELVKVMGHAPESIVIEMARENQTTARGKKNSQQRYKRIEDALKNLAPGLDSNILKEHPTDNIQLQNDRLFLYYLQNGKDMYTGNPLDINQLSSYDIDHIVPQAFIKDDSLDNRVLTSSKDNRGKSDNVPSLEVVQKRKAFWQQLLDSKLISEHKFNNLTKAERGGLDRQDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIVKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 129 - protein, 1376 aa, synthetic construct
MNKPYSIGLDIGTNSVGWAVITDDYKVPSKKMKVLGNTDKKYIKKNLLGALLFEGGETAEGRRLKRTARRRYTRRRNRILYLQEIFAAEMNKVDESFFHRLDDSFLVPEDKRGSKYPIFGTLEEEKEYHKKFPTIYHLRKHLADSKEKADLRLIYLALAHMIKYRGHFLYEDSFDIKNNDIQKIFNEFTSIYDNTFEESSLSKGNAQVEEIFTDKISKSAKRERVLKLFPDEKSTGLFSEFLKLIVGNQADFKKHFDLEEKAPLQFSKDTYDEDLENLLGQIGDMYADLFLVAKKLYDAILLSGILTVTDPTTKAPLSASMIERYENHQEDLAALKQFIKNNLSEKYAEVFSDASKDGYAGYIEGKTTQENFYKFIKKAIEKIEGSDYFIDKIEREDFLRKQRTFDNGSIPHQIHLQEMHAIIRRQAEFYPFLAENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDKTFKVYRKVTKEKLMDFLGKEFDEFRIVDLMGLDKDNKSFNASLGTYHDLKKIVSKDFLDNPENEDILENVVLTLTLFEDREMIRKRLEKYKDVLTEEQRKKLERRHYTGWGRLSAKLINGIRDKVTRKTILDYLIDDGTSNRNFMQLIHDDTLSFVDEIRLAQSSGEAEDYRAEVQNLAGSPAIKKGILQSLKIVDELIEVMGYDPEHIVVEMARENQFTNQGRRNSQQRYKKIKDAIKNLDSNLNSKILKEYPTNNQALQNDRLFLYYLQNGKDMYTGEALDINQLSNYDIDHIIPQAFIKDDSLDNRVLTSSKDNRGKSDNVPSIEVVEKMKAFWQQLLDSKLISERKYNNLTKAERERGGLNELDKVGFIKRQLVETRQITKHVAQILDAKFNTEKDENGKRIRKVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 130 - protein, 1377 aa, synthetic construct
MKKSYSIGLDIGTNSVGWAVVDDDYKVPAKKMRVFGDTDRSHIKKNLLGTLLFDSGETAESRRLKRTARRRYTRRRNRILYLQEIFAEEMNKVDDSFFHRLDESFLTDDDKTFDSHPIFGNKAEEDAYHQKFPTIYHLRKHLADSTEKADLRLVYLALAHMIKFRGHFLIEGELNAENTDVQKLFAQFVGVYDRTFDDSHLSEITVDASSILTEKISKSRRLENLIKHYPTEKKNTLFGNLVALALGLQPNFKTNFKLSEDAKLQFSKDTYEEDLEELLGKIGDEYADLFTSAKNLYDAILLSGILTVDDTSTKAPLSASMIKRYAEHHEDLEKLKEFIKANKPELYHDIFKDETKNGYAGYIENGVKQDEFYKYLKTTLSKIDGSQYFLDKIEREDFLRKQRTFDNGSIPHQIHLQEMHAILRRQGEYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKDKLLDFLNKEFEEFRIVDLIGLDKENKSFNASLGTYHDLKKILDKSFLDDKTNEQIIEDIVLTLTLFEDRDMIRQRLQKYSDIFTPQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTNRGRTQSQQRLKKLQESLKELGSNILNEEKPSYIEDKVENSHLQNDKLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTEADKAGFIKRQLVETRQITKHVAQILDARFNTKRDENDKVIRDVKIITLKSNLVSQFRKEFGFYKVREINDYHHAHDAYLNAVVGTALLKKYPKLAPEFVYGEYIKYDIKGDITKSKIETTRDKATAKYFFYSNLLNFFKTKVRYADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 131 - protein, 1373 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGKTILDYLIDDGVSNRNFMQLIHDDTLSFKKKIQKAQIIGDQDNIKQVVQSLPGSPAIKKGILQSIKIVDELVKVMGREPESIVVEMARENQYTNQGKSNSQQRLKRLEESLKELGSKILKENVPAKLSKIDNNALQNERLYLYYLQNGKDMYTGDDLDIDRLSNYDIDHIIPQAFLKDNSIDNKVLVSSASNRGKSDDVPSIEVVKARKTFWHQLLKSQLISQRKFDNLTKAERGGLTDDDKAGFIRRQLVETRQITKHVAQLLDSRFNTKRDDNDKVIRNVKIITLKSSLVSQFRKEFGLYKVREINDYHHAHDAYLNAVVATAILKKYPKLEPEFVYGDYQKYDVRKYLSTKDNKDLGKATAKMFFYSNLMNFFKKEVRLADGTVVVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 132 - protein, 1371 aa, synthetic construct
MKKYSIGLDIGTNSVGWAVVDDDYKVPAKKMRVFGDTDRSHIKKNLLGTLLFDSGETAESRRLKRTARRRYTRRRNRILYLQEIFAEEMNKVDDSFFHRLDESFLTDDDKNFDSHPIFGNKAEEDAYHQKFPTIYHLRKHLADSTEKADLRLVYLALAHMIKFRGHFLIEGELNAENTDVQKLFEQFVGVYDRTFDDSHLSEITVDASSILTEKISKSRRLENLIKHYPTEKKNTLFGNLVALALGLQPNFKTNFKLSEDAKLQFSKDTYEEDLEELLGKIGDEYADLFTSAKNLYDAILLSGILTVDDNSTKAPLSASMIKRYEEHHEDLEKLKTFIRVNNSDKYHEIFNDKDKNGYAGYIENGVKQDEFYKYLKETLSKIAGSQYFLDKIEREDFLRKQRTFDNGSIPHQIHLQEMHAILRRQGEYYPFLKENQAKIEKILTFRIPYYVGPLARKDSRFAWANYHSDEPITPWNFDEVVDKEKSAEKFITRMTINDLYLPEEKVLPKHSHVYETYAVYNELTKIKYVNEQGKESFFDANMKQEIFEHVFKENRKVTKDKFLNYLNKEFPEYRIQDLIGLDKENKSFNASLGTYHDLKKILDKSFLDDKTNEQIIEDIIQTLTLFEDRDMIRQRLQKYSDIFTKQQLKKLERRHYTGWGRLSYKLINGIRNKENNKTILDYLIDDGYANRNFMQLINDDTLPFKQIIQKSQVVGDIDDIKAVVHDLPGSPAIKKGILQSVKIVDELVKVMGHNPDNIVIEMARENQTTNRGRSQSQQRLKKLQESLKELGSNILNEEKPSYIEDKVENSHLQNDKLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTEADKAGFIKRQLVETRQITKHVAQILDARFNTKRDDNDKVIRDVKVITLKSNLVSQFRKEFGFYKVREINDYHHAHDAYLNAVVGTALLKKYPKLAPEFVYGEYKKYDIRKFITATDDKATAKYFFYSNLLNFFKTKVRYADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 133 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMSKIDESFFQRLDDSFLVPDDKRDSKYPIFGNLVEEKTYHDEFPTIYHLRKYLADSSKKADLRLVYLALAHMIKYRGHFLIEGDFNSKNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLAALKQFIKNNLPEKYDEVFSDQSKDGYAGYIDGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKQSQKTILDYLIDDGEINRNFMQLIHDDGLSFKEIIQKAQVFGKTDDVKQVVQELPGSPAIKKGILQSIKIVDELVKVMGHNPEHIVVEMARENQFTNQGRRNSQQRYKKIMEAIKNLDSNLNSKILKEYPTDNQALQNDRLFLYYLQNGKDMYTGEALDINQLSNYDIDHIIPQAFIKDDSLDNRVLTSSKDNRGKSDNVPSLEIVEKMKGFWQQLLNSKLISERKFNNLTKAERGGLDERDKVGFIKRQLVETRQITKHVAQILDARFNTEVNEKNQKIRTVKIITLKSNLVSNFRKEFGLYKVREINDYHHAHDAYLNAVVAKAILKKYPKLEPEFVYGDYQKYEISRYISRSKISDSIDKATAKYFFYSNLLNFFKEKVRYSNGTVIIRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 134 - protein, 1374 aa, synthetic construct
MTKPYSIGLDIGTNSVGWAVITDNYKVPSKKMKVLGNTSKKYVKKNLLGALLFESGITAEGRRLKRTARRRYTRRRNRILYLQEIFSTEMAEIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLEKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLDRYQFLDKKQKKDIFDTFFKAEDKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLINDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNVQLQNDRLFLYYLQNGKDMYTGEALDINQLSNYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNKKIRKVKIITLKSNLVSNFRKEFELYKVREINDYHHAHDAYLNAVVAKAILKKYPKLEPEFVYGDYQKYDIKRYISKSKDPKEIDKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 135 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHHKDLALLKNLIKQNLTQEKYDEVFSDESKNGYAGYISGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 136 - protein, 1374 aa, synthetic construct
MKKPYSIGLDIGTNSVGWAVITDDYKVPAKKMKVLGNTDKSHIKKNLIGALLFDSGNTAEDRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQEDLAALKQFIRNNLQEKYDEVFSDSSKDGYAGYIEGKTNQEAFYKYMKKLLTKVEGADYFLEKIKDENFLRKQRTFDNGSIPHQVHLREMHAIIRRQGEYYPFLKENREKIEKILTFRIPYYVGPLARGKSDFAWMTRKSDDAIRPWNFEEMVDKEASAMAFIHRMTNNDFYLPEEKVLPKHSLLYEKFAVYNELTKVRYVTEQGKSFFFDANMKQEIFDKTFKVYRKVTKEKLMDFLGKEFDEFRIVDLMGLDKENKSFNASLGTYHDLKKIVSKDFLDNPENEDILENVVLTLTLFEDREMIRKRLEKYKDVLTEEQRKKLERRHYTGWGRLSAKLINGIRDKVTRKTILDYLIDDGTSNRNFMQLIHDDTLSFVDEIRLAQSSGEAEDYRAEVQNLAGSPAIKKGILQSLKIVDELIEVMGYDPEHIVVEMARENQFTNQGRRNSQQRYKKIKEAIKNLDSNLNSKILKEYPTNNQALQNDRLFLYYLQNGKDMYTGEALDINQLSSYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVNEKGKRIRKVKIITLKSNLVSNFRKEFGLYKVREINDYHHAHDAYLNAVVAKAILKKYPKLEPEFVYGDYQKYDIKRYISRSKDPKEIEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 137 - protein, 1372 aa, synthetic construct
MNKPYSIGLDIGTNSVGWAVITDSYKVPSKKMKVLGNTSKKYVKKNLLGALLFESGITAEGRRLKRTARRRYTRRRNRILYLQEIFSTEMKKIDESFFQRLDDSFLVPEDKRGSKYPIFGNLAQEKTYHEKFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLEKIEREDFLRKQRTFDNGSIPHQIHLQEMNAILRRQGEYYPFLKENKEKIEKILTFRIPYYVGPLARGNRDFAWLTRNSDQAIRPWNFEEVVDQASSAEEFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKQSGKTILDFLIDDDKINRNFMQLINDDGLSFKEIIQKAQVVGKTDDIKQVVQNLPGSPAIKKGILQSIKIVDELVKVMGRDPESIVVEMARENQFTNQGRRNSQQRYKKIENAIKNLDKNLNSKILKEYPTNNQALQNDRLFLYYLQNGKDMYKDEELDINQLSNYDIDHIVPQAFIKDDSLDNRVLTSSKDNRGKSDNVPSIEVVQKRKGFWQQLLDSKLISERKFNNLTKAERGGLDERDKVGFIKRQLVETRQITKHVAQILDARFNTEVNENNQKIREVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVTYADGTIKKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 138 - protein, 1367 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKAYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLEDQASLQFSKESYDEDLETLLGHIGDDYSDVFLKAKKLYDAILLSGILTVTDNETEAPLSSAMIMRYKEHEEDLALLKAYIRNISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLSTYHDLLNIINDKEFLDDSSNEAIIEEIIHTLTIFEDREMIKQRLSKFENIFDKSVLKKLSRRHYTGWGRLSAKLINGIRDEKSGKTILDYLIDDGVSNRNFMQLIHDDTLSFKKKIQKAQIIGDQDNIKQVVQSLPGSPAIKKGILQSIKIVDELVKVMGRNPESIVVEMARENQYTNQGKSNSQQRLKRLEESLKDLGSKILKENVPAKLSKIDNNALQNERLYLYYLQNGKDMYTGEELDIDRLSNYDIDHIIPQAFLKDNSIDNKVLVSSASNRGKSDDVPSLDVVKKRKTFWHQLLKSQLISQRKFDNLTKAERGGLTEADKAGFIQRQLVETRQITKHVARLLDARFNTKRDDNDKVIRDVKVITLKSSLVSQFRKDFELYKVREINDFHHAHDAYLNAVVATALLKKYPKLEPEFVYGDYPRYNSFRERKSATERMLFYSNIMNFFKRVKVHLDSNGKVVVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 139 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFSNFLDSYNAIFESDLSLENSKQLEEIVKDKISKSAKRERVLKLFPDEKSTGLFSEFLKLIVGNQAEFKKHFDLEEKAPLQFSKDTYDEDLENLLGQIGDDFADLFLVAKKLYDAILLSGILTVTDPATKAPLSASMIERYENHQKDLSALKQFIKRNLSEKYDEVFSDQSKDGYAGYINGKTTQEAFYKYIKNLLSKLEGADYFLDKIEREDFLRKQRTFDNGSIPHQIHLQEMNAILRRQGEHYPFLKENKEKIQQILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSIFDEKVIKALTRRHYTGWGKLSAKLINGIYDKQSKKTILDYLIDDDKINRNFMQLINDDSLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNVQLQNDRLFLYYLQNGKDMYTGEALDINQLSNYDIDHIVPQAFIKDDSLDNRVLTSSKDNRGKSDNVPSLEVVQKRKAFWQQLLDSKLISQRKFDNLTKAERGGLTEHDKAGFIKRQLVETRQITKHVAQILDARFNTEVNEKNQKIRKVKIITLKSNLVSNFRKEFRLYKVREINDYHHAHDAYLNAVVAKAILKKYPKLEPEFVYGDYQKYDIKRYISRTKDPKAIEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 140 - protein, 1372 aa, synthetic construct
MTKPYSIGLDIGTNSVGWAVISDSYKVPSKKMKVLGNTSKKYVKKNLLGALLFESGITAEGRRLKRTARRRYTRRRNRILYLQEIFATEMSKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLATLKQFIKTNLPEKYDEVFSDQSKDGYAGYIDGKTTQEAFYKYIKNLLSKLEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKQSQKTILDYLIDDGEINRNFMQLIHDDGLSFKEIIQKAQVFGKTDDVKQVVQELPGSPAIKKGILQSIKIVDELVKVMGKDPESIVVEMARENQFTNQGRRNSQQRYKRIENAIKNLDSNLNSKILKEHPTDNQALQNDRLFLYYLQNGKDMYTGEELDINQLSSYDIDHIIPQAFIKDDSIDNRVLTSSKDNRGKSDNVPSLEIVQKRKGFWQQLLNSKLISERKFNNLTKAERGGLDERDKVGFIKRQLVETRQITKHVAQILDARFNTEVDEKGKRIRKVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIIKRENIEYSKDTGEVAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 141 - protein, 1376 aa, synthetic construct
MKKPYSIGLDIGTNSVGWAVITDDYKVPSKKMKVLGNTDKSHIKKNLIGALLFDSGNTAEDRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERILKLFAYEKPTGLFSEFLKLIVGNQADFKKHFDLEEKAPLQFSKDTYDEDLENLLGQIGDMYADLFLVAKKLYDAILLSGILTVTDPTTKAPLSASMIERYEEHQKDLAQLKEFVNQKLSEKYNEVFSDVSKDGYAGYIEGKTTQENFYKFIKKAIEKIEGSDYFLDKINREDLLRKQRTFDNGSIPHQIHLQEMHAIIRRQAEYYPFLAENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKKKLMDFLAKEFDEFRIVDLMGLDKENKSFNASLGTYHDLKKIVSKDFLDNPENEEILENVVLTLTLFEDREMIRKRLEKYKDVLTEEQRKKLERRHYTGWGRLSAKLINGIRDKVTRKTILDYLIDDGTSNRNFMQLIHDDTLSFVDEIRLAQGSGEAEDYRTEVQNLAGSPAIKKGILQSLKIVDELIEVMGYEPEHIVVEMARENQFTNQGRRNSQQRYNKIKEAIKNLDSNLNSKILKEYPTNNQALQNDRLFLYYLQNGKDMYTGEPLDINQLSSYDIDHIVPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDIKRYISRSRDPKEIEKATEKYFFYSNLLNFFKEEVHYADGTIVKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 142 - protein, 1368 aa, synthetic construct
MNKPYSIGLDIGTNSVGWAVITDSYKVPSKKMKVLGNTSKKYVKKNLLGALLFESGITAEGRRLKRTARRRYTRRRNRILYLQEIFATEMNKVDESFFQRLDDSFLVPDDKRDSKYPIFGNLVEEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFVKANLPEKYDEVFSDQSKDGYAGYIDGKTTQEAFYKYIKNLLSKFEGADYFLDKIEREDFLRKQRTFDNGSIPHQIHLQEMNAILRRQGEHYPFLKDNKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLEQYDSLFDEKVIKALTRRHYTGWGKLSAKLINGIRDKQSQKTILDYLIDDDKINRNFMQLINDDGLSFKEIIQKAQVVGKTDDVKQVVQELPGSPAIKKGILQSIKIVDELVKVMGHAPENIVIEMARTNQGQKSSQDRKTRIENGVKNLASDLNGNILKEYPTDNIQLQNDRLFLYYLQNGKDMYTGNPLDINQLSSYDIDHIVPQAFIKDDSLDNRVLTSSKDNRGKSDNVPSIEIVQKRKAFWQQLLDSKLISERKFNNLTKAERGGLDERDKVGFIKRQLVETRQITKHVAQILDARFNTEVNEKGQRIRKVKIITLKSNLVSNFRKEFGLYKVREINDYHHAHDAYLNAVVAKAILKKYPKLEPEFVYGDYQKYDIKRYISRSKEPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 143 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMNKIDESFFQRLDDSFLVPDDKRDSKYPIFGNLVEEKTYHDEFPTIYHLRKYLADSPKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIDRYENHQKDLAALKQFVKANLPEKYDEVFSDQSKDGYAGYIDGKTTQEAFYKYIKNLLNKLEGADYFLDKIEREDFLRKQRTFDNGSIPHQIHLQEMHAILHRQGEHYPFLKENREKIEKILTFRIPYYVGPLARGNRDFAWLTRNSDQAIRPWNFEEVVDQASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDAKNEAILENIVHTLTIFEDREMIKQRLAQYNSLFDEKVIKALTRRHYTGWGRLSAKLINGIRDKQSKKTILDYLIDDDKINRNFMQLIHDDGLSFKEIIQKAQVGSHTDDLKQVVQELAGSPAIKKGILQSLKIVDELIEVMGYDPEHIVVEMARENQFTNQGRRNSQQRYKKIEDAIKNLDSNLNSKILKEYPTNNQALQNDRLFLYYLQNGKDMYTGEELDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDSRFNTEVNDKGQKIRKVKIVTLKSNLVSNFRKEFGLYKVREINDYHHAHDAYLNAVVAKAILKKYPKLEPEFVYGDYQKYDIKRYISRSKDPKDIEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 144 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHEKFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFVKANLPEKYDEVFSDQSKDGYAGYIDGKTTQEAFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKQSNKTILDYLIDDDKINRNFMQLINDDGLSFKDIIQKAQVVGKTDDLKQVVQELPGSPAIKKGILQSIKIVDELVKVMGHAPESIVIEMARENQTTARGKKNSQQRYKRIEEALKNLAPGLDSKILKEHPTDNTQLQNDKLFLYYLQNGRDMYIDEELDINRLSDYDIDHIVPQAFIKDDSLDNRVLTSSKDNRGKSDNVPSLEVVQKRKGFWRQLLNSKLISKRKFDNLTKAERGGLTENDKAGFIKRQLVETRQITKHVAQILDARFNTEVDENNKKIRKVKIITLKSNLVSNFRKEFELYKVREINDYHHAHDAYLNAVVAKAILKKYPKLEPEFVYGDYQKYDIKRYISRSKDPKEVEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 145 - protein, 1371 aa, synthetic construct
MNKPYSIGLDIGTNSVGWAVITDDYKVPSKKMKVLGNTSKKYVKKNLLGALLFESGITAEGRRLKRTARRRYTRRRNRILYLQEIFEKGMSEIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQQFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLATLKQFVKTNLPEKYDEVFSDQSKDGYAGYIDGKTTQEAFYKYIKNLLSKFEGSDYFLDKIEREDFLRKQRTFDNGSIPHQIHLQEMNAIIRRQGEHYPFLKENREKIEKILTFRIPYYVGPLARGNRDFAWLTRNSDQAIRPWNFEEIVDKASSAEEFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIRDKEFMDDPKNEEILENVVHTLTIFEDREMIKQRLAQYDSLFDEKVIKALSRRHYTGWGRLSAKLINGIRDKQSQKTILDYLIDDGEINRNFMQLIHDDGLSFKEIIQKAQVVSHSDDLKQVVQELPGSPAIKKGILQSIKIVDELVKVMGHNPESIVIEMARENQTTNQGRRNSQQRYKKINEAIKNLDSNLNSKILKEYPTNNQALQNDRLFLYYLQNGKDMYTGEALDINQLSNYDIDHIIPQAFIKDDSLDNRVLTSSKDNRGKSDNVPSIEVVEKMKGFWQQLLDSKLISERKFNNLTKAERGGLDERDKVGFIKRQLVETRQITKHVAQLLDARFNVEVNDKKQRIRNVKIITLKSNLVSNFRKEFGLYKVREINDYHHAHDAYLNAVVAKAILKKYPKLEPEFVYGDYQKYDVRKFIKSKSEQEIGKATAKKFFYSNLLNFFKKEVRLADGTVIVRPVVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 146 - protein, 1376 aa, synthetic construct
MKKPYSIGLDIGTNSVGWAVVTDDYKVPAKKMKVLGNTDKSHIKKNLLGALLFDSGNTAEDRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQEDLKQLKRFVNQKLSEKYNEVFSDDSKDGYAGYIEGKTNQEGFYKYIKNLIEKLEGADYFLEKINREDLLRKQRTFDNGSIPHQIHLQEMHAIIRRQAEFYPFLAENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLLDFLDKEFDEFRIVDLIGLDKENKAFNASLGTYHDLKKIVSKDFLDNPENEDILENVVLTLTLFEDREMIRKRLEKYKDVLTEEQRKKLERRHYTGWGRLSAKLINGIRNKTTRKTILDYLIDDGTSNRNFMQLIHDDTLSFVDEIRLAQGSGEAEDYRAEVQNLAGSPAIKKGILQSLKIVDELIEVMGYDPEHIVVEMARENQFTNQGRRNSQQRYKKIKDAIKNLDSNLNSKILKEYPTNNQALQNDRLFLYYLQNGKDMYTGKELDINQLSNYDIDHIVPQAFIKDDSLDNRVLTSSKDNRGKSDNVPSLEVVQKRKAFWQQLLDSKLISERKYNNLTKAERERGGLNELDKVGFIKRQLVETRQITKHVAQILDARFNTEVDENGKRIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 147 - protein, 1384 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLSTYHDLLKIIKDKEFLDDASNEAIIEEIIHTLTIFEDREMIKQRLSKFENIFDKSVLKKLSRRHYTGWGKLSAKLINGIRDEKSGKTILDYLIDDGVSNRNFMQLIHDDTLSFKKKIQKAQIIGDQDNIKQVVQSLPGSPAIKKGILQSIKIVDELVKVMGRNPESIVVEMARENQYTNQGKSNSQQRLKRLEESLKELGSKILKENVPAKLSKIDNNALQNERLYLYYLQNGKDMYTGDDLDIDRLSNYDIDHIIPQAFLKDNSIDNKVLVSSASNRGKSDDVPSLDVVKKRKTFWHQLLKSKLISQRKFDNLTKAERGGLTEDDKAGFIQRQLVETRQITKHVARILDERFNNELDENGKRIRKVKIITLKSSLVSQFRKEFGLYKVREINDYHHAHDAYLNAVVATAILKKYPKLEPEFVYGEYKKYEVKSTYGEKKEYVREIVRSKTDSSLGKATAKMFFYSNLMNFFKKEVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 148 - protein, 1371 aa, synthetic construct
MKKYSIGLDIGTNSVGWAVVDDDYKVPAKKMRVFGDTDRSHIKKNLLGTLLFDSGETAENRRLKRTARRRYTRRRNRILYLQEIFAKEMAKVDESFFHRLDESFLTDDDKTFDSHPIFGNKAEEDAYHQKFPTIYHLRKHLADSTEKADLRLVYLALAHMIKFRGHFLIEGELNAENTDVQKLFAQFVGVYDRTFDDSHLSEITVDASSILTEKISKSRRLENLIKHYPTEKKNTLFGNLVALALGLQPNFKTNFKLSEDAKLQFSKDTYEEDLEELLGKIGDEYADLFTSAKNLYDAILLSGILTVDDNSTKAPLSASMIKRYVEHHEDLEKLKEFIKANKPDFYHDIFKDKDKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKDSRFAWANYHSDEPITPWNFDEVVDKEKSAEKFITRMTLNDLYLPEEKVLPKHSLVYETYTVYNELTKIKYVNEQGKETFFDANMKQEIFEHVFKENRKVTKEKFLNYLNKEFPEYRIQDLIGLDKENKSFNASLGTYHDLKKILDKSFLDDKTNEQIIEDIIQTLTLFEDRDMIRQRLQKYSDIFTKQQLKKLERRHYTGWGRLSYKLINGIRNKENNKTILDYLIDDGYANRNFMQLINDDTLPFKQIIQKSQVVGDIDDIKAVVHDLPGSPAIKKGILQSVKIVDELVKVMGHNPDNIVIEMARENQTTNRGRTQSQQRLKKLQDSLKELGSNILNEEKPSYVEGKVENNHLQNDKLFLYYIQNGKDMYTGEELDIDHLSDYDIDHIIPQAFIKDDSIDNRVLTSSAKNRGKSDDVPSLDIVHDRKADWIRLYKSGLISKRKFDNLTKAERGGLTEADKAGFIKRQLVETRQITKHVAQILDARFNTKRDENDKVIRDVKVITLKSNLVSQFRKDFQFYKVREINDYHHAHDAYLNAVVGTALLKKYPKLAPEFVYGEYKKYDIRKFITNSSDKATAKYFFYSNLLNFFKTKVRYADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 149 - protein, 1371 aa, synthetic construct
MKKYSIGLDIGTNSVGWAVVDDDYKVPAKKMRVFGDTDRSHIKKNLLGTLLFDSGETAESRRLKRTARRRYTRRRNRILYLQEIFAEEMNKVDDSFFHRLDESFLTDDDKTFDSHPIFGNKAEEDAYHQKFPTIYHLRKHLADSTEKADLRLVYLALAHMIKFRGHFLIEGELNAENTDVQKLFAQFVGVYDRTFDDSHLSEITVDASSILTEKISKSRRLENLIKHYPTEKKNTLFGNLVALALGLQPNFKTNFKLSEDAKLQFSKDTYEEDLEELLGKIGDDYADLFTSAKNLYDAILLSGILTVDDESTKAPLSASMVKRYAEHHEDLEKLKEFIKANKPELYHDIFKDETKNGYAGYIENGVKQDEFYKYLKTTLSKIEGSDYFLDKIEREDFLRKQRTFDNGSIPHQIHLQEMHAILRRQGDYYPFLKENQAKIEKILTFRIPYYVGPLARKDSRFAWANYHSDEPITPWNFDEVVDKEKSAEKFITRMTINDLYLPEEKVLPKHSHVYETYAVYNELTKIKYVNEQGKSFFFDANMKQEIFEHVFKENRKVTKDKFLNYLNKEFPEYRIQDLIGLDKENKSFNASLGTYHDLKKILDKSFLDDKTNEQIIEDIVLTLTLFEDRDMIRQRLQKYSDIFTPQQLKKLERRHYTGWGRLSYKLINGIRNKENNKTILDFLIDDGHANRNFMQLINDDSLSFKTIIQEAQVVGDVDDIEAVVHDLPGSPAIKKGILQSVKIVDELVKVMGHNPDNIVIEMARENQTTNRGRSQSQQRLKKLQDSLKELGSNILNEEKPSYIEDKVENSHLQNDKLFLYYIQNGKDMYTGEELDIDHLSDYDIDHIIPQAFIKDDSIDNRVLTSSAKNRGKSDDVPSLDIVHDRKADWIRLYKSGLISKRKFDNLTKAERGGLTEADKAGFIKRQLVETRQITKHVAQILDARFNTERDENDKVIRDVKVITLKSNLVSQFRKDFQFYKVREINDYHHAHDAYLNAVVGTALLKKYPKLAPEFVYGEYKKYDIRKFITNSSDKATAKYFFYSNLLNFFKTKVRYADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 150 - protein, 1372 aa, synthetic construct
MKKPYSIGLDIGTNSVGWAVVTDDYKVPAKKMKVLGNTDKSHIKKNLLGALLFDSGETAEATRLKRTARRRYTRRRNRILYLQEIFAKEMAKVDESFFHRLDESFLTDDDKNFDSHPIFGNKAEEDAYHQKFPTIYHLRKHLADSTEKADLRLVYLALAHMIKFRGHFLIEGQLNAENTDVQTLFNDFVEVYDKTVEESHLSEITVDALSILTEKVSKSRRLENLIKYYPTEKKNTLFGNLIALALGLQPNFKTNFKLSEDAKLQFSKDTYEEDLEELLGKIGDEYADLFTSAKNLYDAILLSGILTVDDESTKAPLSASMIKRYAEHHEDLEKLKEFIKANKPELYHDIFKDETKNGYAGYIENGVKQDEFYKYLKNTLTKIEGSDYFLDKIEREDFLRKQRTFDNGSIPHQIHLQEMHAILRRQGDYYPFLKENQDRIEKILTFRIPYYVGPLARKDSRFAWANYHSDEPITPWNFDEVVDKEKSAEKFITRMTLNDLYLPEEKVLPKHSHVYETYAVYNELTKIKYVNEQGKESFFDANMKQEIFEHVFKENRKVTKEKFLNYLNKEFPEYRIQDLIGLDKENKSFNASLGTYHDLKKILDKSFLDDKTNEQIIEDIIQTLTLFEDRDMIRQRLQKYSDIFTKQQLKKLERRHYTGWGRLSYKLINGIRNKENNKTILDYLIDDGYANRNFMQLINDDTLPFKQIIQKSQVIGDIDDIKAVVHDLPGSPAIKKGILQSVKIVDELVKVMGDNPDNIVIEMARENQTTNRGRTQSQQRLKKLQESLKELGSNILNEEKPSYIEDKVENSHLQNDKLFLYYIQNGKDMYTGEELDIDHLSDYDIDHIIPQAFIKDDSIDNRVLTSSAKNRGKSDDVPSLDIVHDRKADWIRLYKSGLISKRKFDNLTKAERGGLTEADKAGFIKRQLVETRQITKHVAQILDARFNTERDENDKVIRDVKVITLKSNLVSQFRKDFQFYKVREINDYHHAHDAYLNAVVGTALLKKYPKLAPEFVYGEYKKYDIRKFITASGDKATAKYFFYSNLLNFFKTKVRYADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 151 - protein, 1377 aa, synthetic construct
MSNKPYSIGLDIGTNSVGWAVVTDDYKVPAKKMKVLGDTDKSHIKKNLLGALLFEGGETAEGRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIQRYEEHQEDLKKLKQFIKRNIPEKYDEVFSDQSKNGYAGYIDGKTTQEEFYKYLKEKLTSVKGADYFLEKIKNEDFLRKQRTFDNGVIPYQVHLSEMRAILHRQGEYYPFLKENKEKIEKILTFRIPYYVGPLARGNRDFAWLTRNSDEAIRPWNFEEVVDKASSAEDFINKMTNYDLYLPEEKVLPKHSLLYEKFAVYNELTKVRYVTEQGKSFFFDANMKQEIFDKTFKVYRKVTKEKLMDFLGKEFDEFRIVDLMGLDKDNKSFNASLGTYHDLKKIVSKDFLDNPENEDILENVVLTLTLFEDREMIRKRLEKYKDVLTEEQRKKLERRHYTGWGRLSAKLINGIRDKVTRKTILDYLIDDGTSNRNFMQLIHDDTLSFVDEIRLAQGSGEAEDYRTEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTGEALDINQLSNYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNTEVNEKNQKIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 152 - protein, 1372 aa, synthetic construct
MKKSYSIGLDIGTNSVGWAVVDDDYKVPAKKMRVFGDTDRSHIKKNLLGTLLFDSGETAESRRLKRTARRRYTRRRNRILYLQEIFAEEMNKVDDSFFHRLDESFLTDDDKNFDSHPIFGNKAEEDAYHQKFPTIYHLRKHLADSTEKADLRLVYLALAHMIKFRGHFLIEGQLNAENTDVQTLFNDFVEVYDKTVEESHLSEITVDALSILTEKVSKSRRLENLIKYYPTEKKNTLFGNLIALALGLQPNFKTNFKLSEDAKLQFSKDTYEEDLEELLGKIGDEYADLFTSAKNLYDAILLSGILTVDDNSTKAPLSASMLKRYVEHHEDLEKLKEFIKANKSELYHDIFKDENKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFAWANYHSDEPITPWNFDEVVDKEKSAEKFITRMTLNDLYLPEEKVLPKHSHVYETYAVYNELTKIKYVNEQGKSFFFDANMKQEIFEHVFKENRKVTKDKFLNYLNKEFPEYRIQDLIGLDKENKSFNASLGTYHDLKKILDKSFLDDKTNEQIIEDIIQTLTLFEDRDMIRQRLQKYSDIFTKQQLKKLERRHYTGWGRLSYKLINGIRNKENNKTILDYLIDDGYANRNFMQLINDDTLPFKQIIQEAQVVGDVDDIEAVVHDLPGSPAIKKGILQSVKIVDELVKVMGHNPDNIVIEMARENQTTNRGRTQSQQRLKKLQESLKELGSNILNEEKPSYVEGKVENNQLQNDRLFLYYIQNGKDMYTGEELDIDHLSDYDIDHIIPQAFIKDDSIDNRVLTSSAKNRGKSDDVPSLDIVHDRKADWIRLYKSGLISKRKFDNLTKAERGGLTEADKAGFIKRQLVETRQITKHVAQILDSRFNTKRDENDKVIRDVKVITLKSNLVSQFRKDFQFYKVREINDYHHAHDAYLNAVVGTALLKKYPKLAPEFVYGEYKKYDIRKFITASGDKATAKYFFYSNLLNFFKTKVRYADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 153 - protein, 1376 aa, synthetic construct
MKKPYSIGLDIGTNSVGWAVITDDYKVPSKKMKVLGNTDKSHIKKNLIGALLFDSGNTAEDRRLKRTARRRYTRRRNRILYLQEIFSEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLRLFPDEKSTGLFSEFLKLIVGNQADFKKHFELEEKAPLQFSKDTYDEDLEELLGKIGDDYADLFVAAKKLYDAILLSGILTVTDSTTKAPLSSSMVNRYEEHQKDLALLKQFVRTNLPEKYAEVFSDASKDGYAGYIEGKTTQENFYKFIKKAIEKIEGSDYFLDKIEREDFLRKQRTFDNGSIPHQIHLQEMHAIIRRQAEFYPFLAENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLMGLDKDNKSFNASLGTYHDLKKIVSKDFLDNPENEDILENVVLTLTLFEDREMIRKRLEKYKDVLTEEQRKKLERRHYTGWGRLSAKLINGIRDKVTRKTILDYLIDDGTSNRNFMQLIHDDTLSFVDEIRLAQGSGEAEDYRAEVQNLAGSPAIKKGILQSLKIVDELIEVMGYDPEHIVVEMARENQFTNQGRRNSQQRYKKIKDAIKNLDSNLNSKILKEYPTNNQALQNDRLFLYYLQNGKDMYTGEALDINQLSNYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 154 - protein, 1349 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRNISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIEYLHAIDGYDGIELKGIEKQFNSSLSTYHDLLKIIKDKEFLDDSSNEAIIEEIIHTLTIFEDREMIKQRLSKFENIFDKSVLKKLSRRHYTGWGKLSAKLINGIRDEKSGKTILDYLIDDGISNRNFMQLIHDDTLSFKKKIQKAQIIGDQDNIKQVVQSLPGSPAIKKGILQSIKIVDELVKVMGRNPESIVVEMARENQYTNQGKSNSQQRLKRLEESLKELGSKILKEKVPVKLSKIDNKALQNERLYLYYLQNGKDMYTGDDLDIDRLSNYDIDHIIPQAFLKDNSIDNKVLVSSASNRGKSDDVPSLDVVKKRKTFWHQLLKSKLISQRKFDNLTKAERGGLTEADKAGFIKRQLVETRQITKHVAQILDARFNTKRDDNDKLIREVKIITLKSSLVSQFRKEFQLYKVREINDYHHAHDAYLNAVVATALLKKYPKLAPEFVYGEYNRYKSDSKKTKRVSVMSDLTVLFRDNVEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 155 - protein, 1373 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIEYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGKTILDYLIDDGVSNRNFMQLIHDDTLSFKKKIQKAQIIGDQDNIKQVVQSLPGSPAIKKGILQSIKIVDELVKVMGRNPESIVVEMARENQYTNQGKSNSQQRLKRLEESLKELGSKILKENVPVKLSKIDNNALQNDRLYLYYLQNGKDMYTGEELDIDNLSNYDIDHIIPQAFLKDDSIDNKVLVSSASNRGKSDDVPSLEVVRRRKNFWKQLLDSQLISQRKFDNLTKAERGGLTDDDKAGFIKRQLVETRQITKHVAQILDARFNTKRDDNDKVIRNVKIITLKSSLVSQFRKEFGLYKVREINDYHHAHDAYLNAVVATAILKKYPKLEPEFVYGDYQKYDVRKYLSTKDNKDLGKATAKMFFYSNLMNFFKKEVRLSDGTVVVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 156 - protein, 1380 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYAYLKKLLTGLEGADYFLEKINREDLLRKQRTFDNGSIPHQIHLQEMHAILRKQEKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGKTILDYLIDDGVSNRNFMQLIHDDTLSFKKKIQKAQIIGDQDNIKQVVQSLPGSPAIKKGILQSIKIVDELVKVMGRNPESIVVEMARENQYTNQGKSNSQQRLKRLEESLKELGSKILKENVPAKLSKIDNNALQNERLYLYYLQNGKDMYTGDDLDIDRLSNYDIDHIIPQAFLKDNSIDNKVLVSSASNRGKSDDVPSIDVVKKRKTFWHQLLKSQLISQRKFDNLTKAERGGLTEDDKAGFIKRQLVETRQITKHVAQILDSRFNTEVNDKGKKIRKVKIITLKSSLVSQFRKEFGLYKVREINDYHHAHDAYLNAVVATAILKKYPKLEPEFVYGDYQSYSLGHDKIVDVSKLIVKSDSSLGKATAKMFFYSNLMNFFKKKVRLSDGTVVVRPVVEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 157 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDEGFFQRLDDSFLVPDDKRDSKYPIFGNLVEEKVYHEEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSRKTILDYLIDDDKINRNFMQLIHDDGLSFKEIIQKAQVFGKTDDVKQVVQELPGSPAIKKGILQSIKIVDELVKVMGHAPESIVIEMARENQTTNQGKRNSQQRYKRIEDAIKNLSVDLNSKILKEYPTDNQALQNDRLFLYYLQNGKDMYTGEALDINQLSNYDIDHIIPQAFIKDDSLDNRVLTSSKDNRGKSDDVPSIEVVKARKGFWQQLLDSKLISERKFNNLTKAERGGLDERDKVGFIRRQLVETRQITKHVAQILDARFNTEVNDKKQKIRTVKIVTLKSNLVSNFRKEFRLYKVREINDYHHAHDAYLNAVVAKAILKKYPKLEPEFVYGDYQKYDVKRYISRSKDPKDVEKATEKYFFYSNLLNFFKEEVHYADGTIIKRENIEYSKDTGEVAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 158 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKAYHEKFPTIYHLRKYLADSTKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLATLKQFIKSNLSEKYDEVFSDQSKDGYAGYIDGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGMRDYQFLDSGQKKQIVNQLFKEKRKVTEKDIIQFLHNVDGYDGIELKGIEKQFNASLSTYHDLLKIIKDKDFMDDPKNEEILENIIHTLTIFEDREMIKQRLAQYDSLFDEKVIKALTRRHYTGWGKLSAKLINGIYDKQSKKTILDYLIDDGEINRNFMQLINDDGLSFKEIIQKAQVVGKTNDVKQVVQELPGSPAIKKGILQSIKLVDELVKVMGHAPESIVIEMARENQTTARGKKNSQQRYKRIEDALKNLAPGLDSNILKEHPTDNVQLQNDRLFLYYLQNGKDMYTGEALDINQLSNYDIDHIVPQAFIKDDSLDNRVLTSSKDNRGKSDNVPSLEVVQKRKAFWQQLLDSKLISQRKFDNLTKAERGGLTEHDKAGFIKRQLVETRQITKHVAQILDARFNTEVDSKGKRIRKVKIITLKSNLVSNFRKEFGLYKVREINDYHHAHDAYLNAVVAKAILKKYPKLEPEFVYGDYQKYDLKRYISRSKDPKDVEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 159 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAEIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNILTKVEGADYFLEKIKREDFLRKQRTFDNGTIPYQVHLQEMKAILHNQGEYYPFLKENREKIQQILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLINDDGLSFKDIIQKAQVVGKTDDVKQVVQELPGSPAIKKGILQSIKLVDELVKVMGHAPESIVIEMARENQTTARGKKNSQQRYKRIEDALKNLAPGLDGNILKEYPTDNIQLQNDRLFLYYLQNGRDMYTGEPLDINQLSSYDIDHIVPQAFIKDDSLDNRVLTSSKDNRGKSDNVPSLEVVQKRKAFWQQLLDSKLISERKFNNLTKAERGGLDERDKVGFIRRQLVETRQITKHVAQILDARFNAEVNDKKQRIRKVKIITLKSNLVSNFRKEFGLYKVREINDYHHAHDAYLNAVVAKAILKKYPKLEPEFVYGDYQKYDLKRYISRSKDPKEIEKATQKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 160 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSQKKADLRLVYLALAHMIKYRGHFLIEGDFNSKNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKNGYAGYIDGKTTQEEFYKYLKKILTGLEGADYFLEKIKREDLLRKQRTFDNGTIPYQVHLAEMRAIIHRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDAKNEEILENIVHTLTIFEDREMIKQRLAQYDSLFDEKVIKALTRRHYTGWGKLSAKLINGISDKQTGKTILDYLIDDGKINRNFMQLIHDDGLSFKEIIQKAQVVGKTDDLKQVVQELPGSPAIKKGILQSIKIVDELVKVMGHAPESIVIEMARENQTTNQGRRNSQQRYKKIEDAIKNLDSNLNSKILKEYPTDNQALQNERLFLYYLQNGKDMYTGEALDINQLSNYDIDHIVPQAFIKDDSLDNRVLTSSKDNRGKSDNVPSIEIVQKRKAFWQQLLDSKLISERKFNNLTKAERGGLDERDKVGFIKRQLVETRQITKHVAQILDARFNTEVDENNQKIRTVKIITLKSNLVSNFRKEFGLYKVREINDYHHAHDAYLNAVLAKAILKKYPKLEPEFVYGDYQKYDLKRYISRSKDPKDIEKATEKYFFYSNLLNFFKEEVHYADGTIIKRGNVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 161 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFATEMAKIDESFFQRLDDSFLVPDDKRDSKYPIFGNLVEEKTYHDEFPTIYHLRKYLADSQKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKQTNKTILDYLIDDDKINRNFMQLIHDDGLSFKEIIQKAQVVGDTDDLRQVVQNLPGSPAIKKGILQSIKIVDELVKVMGHAPEQIVIEMARENQTTNQGRRNSQQRYKLIEDGVKNLASDLNGNILKEYPTDNQALQNDRLFLYYLQNGKDMYTGEELDINQLSNYDIDHIVPQAFIKDDSLDNRVLTSSKDNRGKSDNVPSIEVVQKRKAFWQQLLDSKLISERKFNNLTKAERGGLDERDKVGFIRRQLVETRQITKHVAQILDARFNTEVDENGKRIRKVKIITLKSNLVSNFRKEFGLYKVREINDYHHAHDAYLNAVVAKAILKKYPKLEPEFVYGDYQKYDISRYISRSKVSDSIDKATAKYFFYSNLLNFFKEKVRYSNGTIIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 162 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMSEIDESFFQRLDDSFLVPDDKRDSKYPIFGNLVEEKTYHDEFPTIYHLRKYLADSQKKADLRLVYLALAHMIKYRGHFLIEGDFNSRNNDIKKNFQDFLDSYNAIFESDLSLENSEQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIKRNLSEKYDEVFSDESKDGYAGYINGKTTQEAFYKYIKNLLSKLEGADYFLEKIEREDFLRKQRTFDNGSIPHQIHLQEMNAIIRRQGEHYPFLKENKEKIQQILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKKTGNTILDYLIDDDKINRNFMQLINDDGLSFKEIIQKAQVVGKTDDVKQVVQELPGSPAIKKGILQSIKIVDELVKVMGHEPESIVIEMARENQTTARGKKNSQQRYKRIEDALKNLAPGLDSNILKEHPTDNIQLQNDRLFLYYLQNGKDMYTGEELDIHHLSDYDIDHIVPQAFIKDDSIDNRVLTSSKDNRGKSDNVPSIEVVQKRKAFWQQLLDSKLISEHKFNNLTKAERGGLDERDKVGFIRRQLVETRQITKHVAQILDARFNTEVNEKGQKIRKVKIVTLKSNLVSNFRKEFELYKVREINDYHHAHDAYLNAVVAKAILKKYPKLEPEFVYGDYQKYDVKRYISRSKDPRDLHKATEKYFFYSNLLNFFKEEVHYADGTIVFRRNVEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 163 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMSKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQQFLDSYNSLYESDFSLENNAQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNIPEKYDEVFADQSKDGYAGYIDGKTTQEAFYKYVKEKLNNLKGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEEFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKKTGKTILDYLIDDDKINRNFMQLINDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKEHPTDNTALQNDRLFLYYLQNGRDMYTGNPLDINQLSSYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVDENNQKIRKVKIVTLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 164 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSQKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFNLEEKAPLHFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLEKIEREDFLRKQRTFDNGSIPYQIHLQEMRAILSRQGEYYPFLKDNKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKKSGKTILDYLIDDDKINRNFMQLINDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKEHPTDNIQLQNDRLFLYYLQNGKDMYTGNPLDINQLSSYDIDHIVPQAFIKDDSLDNRVLTSSKDNRGKSDNVPSLEVVQKRKAFWQQLLDSKLISERKYNNLTKAERERDGLNELDKVGFIKRQLVETRQITKHVAQILDARFNTEVNEKNQKIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 165 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFATEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLATLKQFIKNNLSEKYDEVFSDQSKDGYAGYIDGKTTQEAFYKYIKNTLSKIEGADYFLDKIEREDFLRKQRTFDNGSIPHQIHLQEMHAIIHRQGEYYPFLQENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDTLFDEKVIKALTRRHYTGWGKLSAKLINGIRDKQSQKTILDYLIDDDKINRNFMQLINDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEELDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVNDKNQKIRTVKIITLKSNLVSNFRKEFRLYKVREINDYHHAHDAYLNAVVAKAILKKYPKLEPEFVYGDYHHYDLKRQISKSKISKSIDKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 166 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLAKFEGADYFLEKIEREDFLRKQRTFDNGSIPYQIHLQEMQAIIHRQGEYYPFLKENKEKIEKILTFRIPYYVGPLARGNRDFAWLTRNSDQAIRPWNFEEIVDQASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKAFMDDAKNEAILENIIHTLTIFEDREMIKQRLAQYDSLFDEKVIKALTRRHYTGWGKLSAKLINGICDKQTGDTILDYLIDDDKINRNFMQLINDDGLSFKEIIQKAQVVGKTDDVKQVVQELPGSPAIKKGILQSIKIVDELVKVMGYEPEQIVIEMARENQTTNQGRRNSQQRYKLLEDGVKNLAKDLDGNILKEYPTDNQALQNDRLFLYYLQNGKDMYTGEPLDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNVEVNDKKQKIRTVKIITLKSNLVSNFRKEFGLYKVREINDYHHAHDAYLNAVVAKAILKKYPKLEPEFVYGDYQKYDLKRYISRSKDPKDVEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 167 - protein, 1372 aa, synthetic construct
MTKPYSIGLDIGTNSVGWAVITDNYKVPSKKMKVLGNTSKKYVKKNLLGALLFESGITAEGRRLKRTARRRYTRRRNRILYLQEIFATEMNKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLEKIEREDFLRKQRTFDNGSIPHQIHLQEMNAIIRRQGEYYPFLQENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKQSQKTILDYLIDDDQINRNFMQLINDDGLSFKEIIQKAQVVGKTDDLRQVVQNLPGSPAIKKGILQSIKLVDELVKVMGKDPESIVIEMARENQTTARGKKNSQQRYKRIEDALKNLAPGLDSNILKEHPTDNIQLQNDRLYLYYLQNGKDMYTGNPLDINQLSNYDIDHIVPQAFIKDDSIDNRVLTSSKDNRGKSDNVPSIEIVQKRKAFWQQLLDSKLISERKFNNLTKAERGGLDEKDKVGFIRRQLVETRQITKHVAQILDARFNTELDENGKRIRKVKIVTLKSNLVSNFRKEFGLYKVREINDYHHAHDAYLNAVVAKAILKKYPKLEPEFVYGDYQKYDVKRYISRSKNPKEIDKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 168 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKGNLSEKYDEVFSDQSKDGYAGYIDGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDFLIDDDKINRNFMQLINDDGLSFKEIIQKAQVVGKTDDLKQVVQELPGSPAIKKGILQSIKIVDELVKVMGHAPEQIVIEMARENQTTNQGRRNSRQRYKLIEDGVKNLASDLNGNILKEYPTDNQALQNDRLFLYYLQNGKDMYTGEELDINQLSNYDIDHIVPQAFIKDDSLDNRVLTSSKDNRGKSDNVPSLEIVQKRKGFWQQLLDSKLISERKFNNLTKAERGGLDERDKVGFIKRQLVETRQITKHVAQILDSRFNTEVDEKGKKIRDVKIITLKSNLVSNFRKEFGLYKVREINDYHHAHDAYLNAVVAKAILKKYPKLEPEFVYGDYQKYDIKRYISRSKDPKDVEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 169 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQNFLDSYNAIFESDLSLENNAQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLPEKYDEVFSDESKDGYAGYINGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGISDKQTGNTILDYLIDDDKINRNFMQLIHDDGLSFKEIIQKAQVVGESDNLKQVVQNLPGSPAIKKGILQSIKIVDELVKVMGKDPEHIVVEMARENQFTNQGRRNSQQRYKKIMDAIKNLDSNLNSKILKEYPTNNQALQNDRLFLYYLQNGKDMYTGEPLDINQLSNYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNTEVNEKGKKIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 170 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGKIPYQIHLQEMRAIIDKQAKFYPFLAKNKEKIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLATYHDLLNIINDKEFLDDSSNEAIIEEIIHTLTIFEDREMIKQRLSKFENIFDKSVLKKLSRRHYTGWGKLSAKLINGIRDEKSGKTILDYLIDDGVSNRNFMQLIHDDTLSFKKKIQKAQIIGDQDNIKQVVQSLPGSPAIKKGILQSIKIVDELVKVMGREPESIVVEMARENQYTNQGKSNSQQRLKRLEESLKDLGSKILKENVPAKLSKIDNNALQNERLYLYYLQNGKDMYTGQDLDIDRLSNYDIDHIIPQAFLKDNSIDNKVLVSSASNRGKSDDVPSLEVVRQRKTFWHQLLKSKLISQRKFDNLTKAERGGLTEDDKAGFIKRQLVETRQITKHVAQILDSRFNTERDDNDKVIRNVKIITLKSNLVSQFRKDFQLYKVREINDYHHAHDAYLNAVVATAILKKYPKLEPEFVYGDYKKYDVRKLISKSDQSMGKATAKMFFYSNLMNFFKKKVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 171 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFATEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALSRRHYTGWGRLSAKLINGIHDKQSRKTILDYLIDDDKINRNFMQLINDDGLSFKEIIQKAQVVGKTDDLKQVVQNLPGSPAIKKGILQSIKIVDELVKVMGREPESIVVEMARENQFTNQGRRNSQQRYKKIKDAIKNLDSNLNSKILKEYPTNNQALQNDRLFLYYLQNGKDMYTGEALDINQLSNYDIDHIIPQAFIKDDSLDNRVLTSSKDNRGKSDNVPSIEIVEKMKGFWQQLLDSKLISERKFNNLTKAERGGLDERDKVGFIRRQLVETRQITKHVAQILDARFNTEVNDKKQRIRKVKIVTLKSNLVSNFRKEFGLYKVREINDYHHAHDAYLNAVVAKAILKKYPKLEPEFVYGDYQKYDLKRYISSSNPSKEIDKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 172 - protein, 1372 aa, synthetic construct
MNKPYSIGLDIGTNSVGWAVITDNYKVPSKKMKVLGNTSKKYVKKNLLGALLFESGITAEGRRLKRTARRRYTRRRNRILYLQEIFATEMAKIDESFFQRLDDSFLVPDDKRDSKYPIFGNLAQEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLISKIEGADYFLEKIEREDFLRKQRTFDNGSIPHQIHLQEMNAILHNQGDYYPFLKENKEKIQQILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIIHTLTIFEDREMIKQRLAQYDSLFDEKVIKALTRRHYTGWGKLSAKLINGIRDKQSNKTILDYLIDDDKINRNFMQLINDDGLSFKEIIQKAQVVGKTDDVKQVVQELPGSPAIKKGILQSIKLVDELVKVMGSDPESIVIEMARENQTTNQGRRNSQQRYKKIEEAIKNLDSNLNSKILKEYPTDNQALQNDRLFLYYLQNGKDMYTGEELDINQLSNYDIDHIVPQAFIKDDSLDNRVLTSSKDNRGKSDNVPSIEVVQKRKGFWQQLLDSKLISERKFNNLTKAERGGLDERDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDVKRYISRSKDPKEIEKATEKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 173 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKVYHDEFPTIYHLRKYLADSSKKADLRLVYLALAHMIKYRGHFLIEGDFNSRNNDIKKNFQEFLDSYNAIFESDLSLENNAQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAQLKQFIKASLPEKYYDVFADESKNGYAGYIENGVKQDEFYKYLKNTLNKIEGSDYFLDKIEREDFLRKQRTFDNGSIPHQIHLQEMNAIIRRQGEHYPFLQENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGNTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGKELDINQLSNYDIDHIVPQAFIKDDSLDNRVLTSSKDNRGKSDNVPSIEVVQKRKAFWQQLLDSKLISERKFNNLTKAERGGLNELDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 174 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKVDESFFQRLDDSFLVPDDKRDSKYPIFGNLVEEKTYHDEFPTIYHLRKYLADSSKKADLRLVYLALAHMIKYRGHFLIEGDFNSRNNDIKKNFQNFLDSYNAIFESDLSLENSEQLEEIVKDKISKSAKRERVLKLFPDEKSTGLFSEFLKLIVGNQAEFKKHFDLEEKAPLQFSKDTYDEDLENLLGQIGDGFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLDKIEREDFLRKQRTFDNGSIPHQIHLQEMNAILRRQGEHYPFLKENKEKIQQILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHFLHNVDGYDGIELKGIEKQFNASLSTYHDLLKIIKDKDFMDDPKNEEILENIVHTLTIFEDREMIKQRLAQYDSLFDEKVIKALTRRHYTGWGKLSAKLINGICDKQTGDTILDYLIDDDKINRNFMQLIHDDGLSFKEIIQKAQVFGKTNDVKQVVQELPGSPAIKKGILQSIKIVDELVKVMGHAPESIVIEMARENQTTNQGRRNSQQRYKLIEDGVKNLASDLNGNILKEYPTDNQALQNDRLFLYYLQNGKDMYTGNPLDINQLSNYDIDHIVPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNTEVDENNQKIRKVKIITLKSNLVSNFRKEFGLYKVREINDYHHAHDAYLNAVVAKAILKKYPKLEPEFVYGDYQKYDLKRYISRSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 175 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDESKNGYAGYIENGVKQDEFYKYLKETLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMDFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 176 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDENFFQRLDDSFLVPDDKRDSKYPIFGNLVEEKVYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLSLFPDEKSTGLFSEFLKLIVGNQADFKKHFDLEEKAPLQFSKDTYDEDLENLLGQIGDDFADLFLVAKKLYDAILLSGILTVTDPSTKAPLSASMIDRYENHQKDLAALKQFVKANLPEKYDEVFSDQSKDGYAGYIDGKTTQEAFYKYIKNTLSKIEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDTLFDEKVIKALTRRHYTGWGKLSAKLINGICDKQTGDTILDYLIDDDKINRNFMQLINDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVNEKNQKIRKVKIVTLKSNLVSNFRKEFKLYKVREINDYHHAHDAYLNAVVAKAILKKYPKLEPEFVYGDYQKYDVKRYISRKELTTSQDKATAKYFFYSNLLNFFKKEVRLADGTIVVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 177 - protein, 1375 aa, synthetic construct
MNKKYSIGLDIGTNSVGWAVVDDDYKVPAKKMRVFGDTDRSHIKKNLLGALLFDSGETAESRRLKRTARRRYTRRRNRILYLQEIFAEEMAKVDESFFHRLDESFLTDDDKTFDSHPIFGNKAEEDAYHKQFPTIYHLRKHLADSSEKADLRLVYLALAHMIKFRGHFLIEGELNAENTDVQKLFEQFVGVYDRTFDDSHLSEITVDASSILTEKISKSRRLEKLIKHYPTEKKNTLFGNLIALSLGLQPNFKTNFKLSEDAKLQFSKDTYEEDLEELLGKIGDDYADLFTLAKNLYDAILLSGILTVDDESTKAPLSASMIKRYAEHHEDLEKLKEFVKANKPELYHDIFKDETKNGYAGYIENGVKQDEFYKYLKNTLSKIDGSQYFLDKIEREDFLRKQRTFDNGSIPHQIHLQEMHAILHRQGEYYPFLKENQAKIEKILTFRIPYYVGPLARKNSRFAWANYHSDEPITPWNFDEVVDKEKSAEKFITRMTLNDLYLPEEKVLPKHSLVYETYTVYNELTKVKYVNEQGKESFFDANMKQEIFDHVFKENRKVTKDKLLNYLDKEFPEYRIQDLIGLDKENKSFNASLGTYHDLKKILDKSFLDDKENEQIIEDIIQTLTLFEDRDMIRQRLQKYSDIFTKQQLKKLERRHYTGWGRLSYKLINGIRDKKSGKSILDYLIDDGYANRNFMQLINDDTLPFKQIIQKAQVVGDIDDIKAVVHDLPGSPAIKKGILQSVKIVDELVKVMGHNPDNIVIEMARENQTTNRGRTQSQQRLKKLQESLKDLGSNILNEEKPSYIEDKVENSHLQNDKLFLYYIQNGKDMYTGDELDIDHLSDYDIDHIVPQAFIKDDSIDNRVLTSSSKNRGKSDDVPSIEVVCARKADWMRLRKAGLISQRKFDNLTKAERGGLTEHDKAGFIKRQLVETRQITKHVAQILDSRFNTKRDDNDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIEVNEETGEIVWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 178 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMSKIDESFFQRLDDSFLVPDDKRDSKYPIFGNLVEEKAYHDEFPTIYHLRKYLADSSKKADLRLVYLALAHMIKYRGHFLIEGDFNSKNNSIKKTFQQFLDSYNAIFEDDLSLKNSEQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKETLSKIEGSDYFLDKIEREDFLRKQRTFDNGSIPHQIHLQEMNAILRRQGEHYPFLKENKEKIEKILTFRIPYYVGPLARGNRDFAWLTRNSDQAIRPWNFEEVVDQASSAEEFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLINDDGLSFKDIIQKAQVVGKTDDVKQVVQELPGSPAIKKGILQSIKLVDELVKVMGHAPESIVIEMARENQTTARGKKNSQQRYKRIEDALKNLAPGLDSNILKENPTDNVQLQNDRLFLYYLQNGKDMYTGEALDINQLSNYDIDHIVPQAFIKDDSLDNRVLTSSKDNRGKSDNVPSLEVVQKRKGFWQQLLDSKLISERKFNNLTKAERGGLDERDKVGFIRRQLVETRQITKHVAQILDERFNTEVDSKGKKIRKVKIITLKSNLVSNFRKEFGLYKVREINDYHHAHDAYLNAVVAKAILKKYPKLEPEFVYGDYQKYDIKRYISRSKDPKEVEKATEKYFFYSNLLNFFKEEVHYADGTIVKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 179 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFIAEMNKIDESFFQRLDDSFLVPDDKRGSKYPIFGNLAKEKTYHDEFPTIYHLRKYLADSTKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLEKIKREDFLRKQRTFDNGTIPYQVHLTEMKAILHRQGDYYPFLKENKEKIEQILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIHFLHNVDGYDGIELKGIEKQFNASLSTYHDLLKIIKDKEFMDDAKNEAILENIIHTLTIFEDREMIKQRLAQYDSLFDEKVIKALTRRHYTGWGKLSAKLINGIRDKQTGKTILDYLIDDGEINRNFMQLIHDDGLSFKEIIQKAQVVGKTDDLKQVVQELPGSPAIKKGILQSIKIVDELVKVMGHAPESIVIEMARENQTTNQGKRNSQQRYKRIEDGVKNLASDLNGNILKEYPTDNQALQNDRLFLYYLQNGKDMYTGEPLDINQLSNYDIDHIVPQAFIKDDSLDNRVLTSSKDNRGKSDNVPSIEVVEKMKGFWQQLLDSKLISERKFNNLTKAERGGLDERDKVGFIKRQLVETRQITKHVAQILDARFNTEVDEKGKKIRKVKIITLKSNLVSNFRKEFGLYKVREINDYHHAHDAYLNAVVAKAILKKYPKLEPEFVYGDYQKYDLKRYISKSKNPKEIDKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 180 - protein, 1368 aa, synthetic construct
MNKPYSIGLDIGTNSVGWAVITDSYKVPSKKMKVLGNTSKKYVKKNLLGALLFESGITAEGRRLKRTARRRYTRRRNRILYLQEIFAAEMNKIDESFFQRLDDSFLVPDDKRGSKYPIFGNLAKEKTYHDEFPTIYHLRKYLADSSKKADLRLVYLALAHMIKYRGHFLIEGDFNSKNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLATLKQFIKTNLPEKYDEVFSDQSKDGYAGYIDGKTTQEAFYKYIKNLLSKIEGADYFLEKIEREDFLRKQRTFDNGSIPHQIHLQEMNAILRRQGEHYPFLKENKEKIQQILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKEIIQKAQVVGKTDDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSSYDIDHIVPQAFIKDDSLDNRVLTSSKDNRGKSDNVPSLEVVQKRKAFWQQLLDSKLISERKFNNLTKAERGGLTEHDKAGFIKRQLVETRQITKHVAQILDERFNTEVNEEGKRIRKVKIITLKSNLVSNFRKEFGLYKVREINDYHHAHDAYLNAVVAKAILKKYPKLEPEFVYGEYKKYHIKSSLNSKTIDKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 181 - protein, 1372 aa, synthetic construct
MTKPYSIGLDIGTNSVGWAVISDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYINGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKAFMDDAKNEEILENIVHTLTIFEDREMIKQRLAQYDSLFDEKVIKALTRRHYTGWGKLSARLIDGIYDKQSRKTILDYLIDDGEINRNFMQLIHDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSLEVVQRRKAFWQQLLDSKLISERKFNNLTKAERGGLTEHDKAGFIKRQLVETRQITKHVAQILDARFNTEVDEKGKRIRKVKIITLKSNLVSNFRKEFGLYKVREINDYHHAHDAYLNAVVAKAILKKYPKLEPEFVYGDYQKYDIKRYISRSKDSKDIEKATEKYFFYSNLLNFFKEEVHYADGTIVKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 182 - protein, 1372 aa, synthetic construct
MKKPYSIGLDIGTNSVGWAVITDDYKVPSKKMKVLGNTSKKYVKKNLLGALLFESGITAEGRRLKRTARRRYTRRRNRILYLQEIFSTEMAQIDDSFFQRLDDSFLVPDDKRDSKYPIFGNLVEEKVYHDEFPTIYHLRKYLADSQKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKFEGADYFLEKINRDDLLRKQRTFDNGSIPHQIHLQEMHAIIRRQGEYYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGNTILDYLIDDDKINRNFMQLINDDGLSFKEIIQKAQVVGETDNIKQVVQELPGSPAIKKGILQSLKIVDELIEVMGYDPEHIVVEMARENQFTNQGRRNSQQRYKKIEDAIKNLDSNLNSKILKEYPTDNNALQNDRLFLYYLQNGKDMYTGEALDINQLSNYDIDHIIPQAFIKDDSLDNRVLTSSKDNRGKSDNVPSIEIVEKMKGFWQQLLNSKLISERKFNNLTKAERGGLDERDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 183 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSQKKADLRLVYLALAHMIKYRGHFLIEGDFNSRNNDIKKNFQNFLDSYNAIFESDLSLENNAQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIDRYENHQKDLAALKQFIKANLPEKYDEVFSDQSKDGYAGYIDGKTTQEAFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDFLIDDDKINRNFMQLINDDGLSFKEIIQKAQVVGKTDDVKQVVQELPGSPAIKKGILQSIKIVDELVKVMGYEPEQIVIEMARENQTTNQGRRNSQQRYKLIEDGVKNLASDLDGNILKEYPTDNQALQNDRLFLYYLQNGKDMYTGESLDINQLSSYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDIKRYISRSKDPKAIEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 184 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAEIDESFFQRLDDSFLVPDDKRDSKYPIFGNLVKEKTYHDEFPTIYHLRKYLADSSKKADLRLVYLALAHMIKYRGHFLIEGDFNSKNNDIKKNFQEFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLPEKYDEVFSDDSKDGYAGYIDGKTSQEDFYKYLKKLLTGIEGADYFLEKIEREDFLRKQRTFDNGVIPYQIHLQEMKAILHNQGEYYPFLKENKEKIEQILTFRIPYYVGPLARGNRDFAWLTRNSDQAIRPWNFEEIVDKASSAEDFINKMTNYDLYLPEEKVLPKHSLLYERFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDYLIDDDKINRNFMQLIHDDGLSFKEIIQKAQVVGKTDDLKQVVQELPGSPAIKKGILQSIKIVDELVKVMGYEPEQIVIEMARENQTTNQGRRNSRQRYKLLEDGVKNLASDLNGNILKEYPTDNQALQNDRLFLYYLQNGKDMYTGEALDINQLSSYDIDHIIPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTELDENGKRIRKVKIITLKSNLVSNFRKEFGLYKVREINDYHHAHDAYLNAVVAKAILKKYPKLEPEFVYGDYQKYDLKRYISRSKDPKEVEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 185 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFATEMAKIDESFFQRLDDSFLVPDDKRDSKYPIFGNLAQEKTYHDEFPTIYHLRKYLADSSKKADLRLVYLALAHMIKYRGHFLIEGDFNSRNNDIKKNFQNFLDSYNAIFESDLSLKNSEQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDESKDGYAGYIDGKTTQEAFYKYIKNLLSKLEGADYFLDKIEREDFLRKQRTFDNGSIPHQIHLQEMNAILRRQGEHYPFLQENKEKIEKILTFRIPYYVGPLARGNRDFAWLTRNSDQAIRPWNFEEVVDKASSAEDFINKMTNYDLYLPEEKVLPKHSLLYERFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIIHTLTIFEDREMIKQRLAQYDSLFDEKVIKALTRRHYTGWGKLSAKLINGIYDKQSKKTILDYLIDDDKINRNFMQLINDDGLSFKDIIQKAQVVGKTDDVKQVVQNLPGSPAIKKGILQSIKIVDELVKVMGSDPESIVIEMARENQTTNQGRRNSQQRYKKIEDAIKNLDSNLNSKILKEYPTDNQALQNDRLFLYYLQNGKDMYTGEPLDINQLSNYDIDHIVPQAFIKDDSLDNRVLTSSKDNRGKSDNVPSEEVVKRMRGFWRQLLDSKLISQRKFDNLTKAERGGLTEHDKAGFIKRQLVETRQITKHVAQILDARFNTEVDEKNKRIRNVKIITLKSNLVSNFRKEFRLYKVREINDYHHAHDAYLNAVVAKAILKKYPKLEPEFVYGDYQKYDIKRYIKRSKPHGTVEKATQKYFFYSNLLNFFKEEVHYADGTIVKREAVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 186 - protein, 1369 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSTKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGTIPYQIHLQEMRAILDKQAKFYPFLAKNKEKIEKILTFRIPYYVGPLARGNSDFAWSIRKRNEKITPWNFEDVIDKESSAEAFINRMTSFDLYLPEEKVLPKHSLLYETFTVYNELTKVKFIAEGMRDYQFLDSKQKKDIVRLYFKGKRKVTDKDIIEYLHAIDGYDGIELKGIEKQFNSSLATYHDLLNIINDKEFLDDSSNEAIIEEIIHTLTIFEDREMIKQRLSKFENIFDKSVLKKLSRRHYTGWGKLSAKLINGIRDEKSGKTILDYLIDDGVSNRNFMQLIHDDTLSFKKKIQKAQIIGDQDNIKQVVQSLPGSPAIKKGILQSIKIVDELVKVMGRRPESIVVEMARENQYTNQGKSNSQQRLKRLEESLKELGSKILKENVPVKLSKIDNQALQNDRLYLYYLQNGKDMYTGEELDIDRLSNYDIDHIIPQSFLTDNSIDNKVLVSSASNRGKSDDVPSLEVVKKRKGFWHQLLKSKLISKRKFDNLTKAERGGLTEADKAGFIKRQLVETRQITKHVAQILDARFNTEKDEDNKAIRTVKVITLKSNLVSQFRKDFELYKVREINDFHHAHDAYLNAVVATAILKKYPKLEPEFVYGEYKKYDIRKFITNSSDKATAKYFFYSNLMNFFKRVIRYANGKVIVRPVVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 187 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKVDENFFQRLDDSFLVPDDKRDSKYPIFGNLVEEKAYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFVKANLPEKYDEVFSDQSKDGYAGYIDGKTTQEAFYKYIKNLLSKFEGADYFLEKIEREDFLRKQRTFDNGSIPHQIHLQEMNAIIRRQGEYYPFLKENKEKIEKILTFRIPYYVGPLARGNRDFAWLTRNSDQAIRPWNFEEIVDQASSAEEFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALARRHYTGWGKLSAKLINGIYDKQSKKTILDYLIDDDKINRNFMQLINDDGLSFKEIIQKAQVVGKTDDVKQVVQELPGSPAIKKGILQSIKIVDELVKVMGHAPESIVIEMARENQTTNQGRRNSQQRYKKIQEAIKNLAPDLDGNILKEYPTDNQALQNDRLFLYYLQNGKDMYTGESLDINQLSSYDIDHIVPQAFIKDDSLDNRVLTSSKDNRGKSDNVPSLEVVQKRKAFWQQLLDSKLISERKFNNLTKAERGGLNERDKVGFIKRQLVETRQITKHVAQILDARFNTEVNEEGKRIRKVKIITLKSNLVSNFRKEFGLYKVREINDYHHAHDAYLNAVVAKAILKKYPKLEPEFVYGDYQKYDIKRYISRSKNPKEIDKATEKYFFYSNLLNFFKEEVHYADGTIVKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 188 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLAQEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLASLKQFIQNNLQEKYDEVFSDQSKDGYAGYIDGKTTQEAFYKYIKNLLSKFEGSDYFLDKIEREDFLRKQRTFDNGSIPHQIHLQEMNAILRRQGEHYPFLKENKEKIEQILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKDFMDDPKNEEILENIVHTLTIFEDREMIKQRLAQYDSIFDEKVIKALTRRHYTGWGKLSAKLINGIYDKQSKKTILDYLIDDDKINRNFMQLINDDGLSFKEIIQKAQVVGKTDDVKQVVQELPGSPAIKKGILQSIKIVDELVKVMGHAPESIVIEMARENQTTNQGRRNSQQRYKLIEDGVKNLASDLNGNILKEYPTNNQALQNERLFLYYLQNGKDMYTGEALDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDLKRYISKSKDPKDIEKATEKYFFYSNLLNFFKEEVHYADGTIIKRENVEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 189 - protein, 1372 aa, synthetic construct
MNKPYSIGLDIGTNSVGWAVVTDSYKVPSKKMKVLGNTSKKYVKKNLLGALLFESGITAEGRRLKRTARRRYTRRRNRILYLQEIFSEEMNKIDDSFFQRLDDSFLVVEDKRGERHPIFGNLAQEKTYHEKFPTIYHLRKYLADSSKKADLRLVYLALAHMIKYRGHFLIEGDFNSRNNDIKGTFQKFLDSYNAIFESDLSLKNSEQLEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDKASSAEDFINKMTNYDLYLPEEKVLPKHSLLYERFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGNTILDYLIDDDKINRNFMQLINDDGLSFKDIIQKAQVVGKTDDVKQVVQELPGSPAIKKGILQSIKIVDELVKVMGHAPESIVIEMARENQTTNQGKRNSQQRYKRLEEGIKNLAKDLNGNILKEYPTDNQALQNDRLFLYYLQNGKDMYTGEPLDINQLSSYDIDHIIPQAFIKDDSLDNRVLTSSKDNRGKSDNVPSLEVVQKRKAFWQQLLDSKLISERKFNNLTKAERGGLNELDKVGFIKRQLVETRQITKHVAQILDERFNNEVDSKGKRIRKVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 190 - protein, 1372 aa, synthetic construct
MTKPYSIGLDIGTNSVGWAVISDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQKDLATLKQFIKNNLSEKYDEVFSDQSKDGYAGYIDGKTTQEAFYKYIKNLLSKFEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDTLFDEKVIKALTRRHYTGWGKLSAKLINGIRDNRTRKTILDYLIDDGEINRNFMQLIHDDGLSFKEIIQKAQVVGKTDDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGRDMYTGEPLDINQLSNYDIDHIVPQAFIKDDSLDNRVLTSSKDNRGKSDNVPSIEVVQKRKGFWRQLLDSQLISQRKFDNLTKAERGKLTEKDKAGFIKRQLVETRQITKHVAQILDARFNTKRDENDKVIRDVKIITLKSNLVSNFRKEFGLYKVREINDYHHAHDAYLNAVVAKAILKKYPKLEPEFVYGDYQKYDIKRYISRSKDPKDVEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 191 - protein, 1372 aa, synthetic construct
MKKSYSIGLDIGTNSVGWAVVDDDYKVPAKKMRVFGDTDRSHIKKNLLGTLLFDSGETAESRRLKRTARRRYTRRRNRILYLQEIFAEEMAKVDDSFFHRLDESFLTDDDKTFDSHPIFGNKAEEDAYHQKFPTIYHLRKHLADSTEKADLRLVYLALAHMIKFRGHFLIEGQLNAENTDVQTLFNDFVEVYDKTVEESHLAEITVDALSILTEKVSKSRRLENLIKYYPTEKKNTLFGNLVALALGLQPNFKTNFKLSEDAKLQFSKDTYEEDLEELLGKIGDEYADLFTSAKNLYDAILLSGILTVDDNSTKAPLSASMIKRYEEHHEDLEKLKTFVKANNSDKYHEIFSDKDKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFAWANYHSDEPITPWNFDEVVDKEKSAEKFITRMTLNDLYLPEEKVLPKHSHVYETFAVYNELTKIKYVNEQGKSFFFDANMKQEIFDHVFKENRKVTKDKLLDFLNKEFEEFRIVDLIGLDKENKSFNASLGTYHDLKKILDKSFLDDKTNEQIIEDIVLTLTLFEDRDMIRQRLQKYSDIFTKQQLKKLERRHYTGWGRLSYKLINGIRNKENNKTILDFLIDDGRANRNFMQLINDDSLSFKTIIQEAQVVGDVDDIEAVVHDLPGSPAIKKGILQSVKIVDELVKVMGHNPDNIVIEMARENQTTNRGRVQSQQRLKKLQESLKELGSEILNVEKPSYVEGKVENNHLQNDKLFLYYIQNGKDMYTGEELDIDHLSDYDIDHIIPQAFIKDDSIDNRVLTSSAKNRGKSDDVPSLEIVHDRKADWIRLYKSGLISKRKFDNLTKAERGGLTEADKAGFIKRQLVETRQITKHVAQILDARFNTERDENDKVIRDVKVITLKSNLVSQFRKDFKFYKVREINDYHHAHDAYLNAVVGTALLKKYPKLAPEFVYGEYKKYDIRKFITNSSDKATAKYFFYSNLLNFFKTKVRYADGTILVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 192 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFATEMNKVDESFFHRLDDSFLVPEDKRGERHPIFGNLEEEKAYHEKFPTIYHLRKYLADSSKKADLRLVYLALAHMIKYRGHFLIEGDFNSRNNDIKKNFQEFLDSYNAIFESDLSLENSAQVEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFVKTNLPEKYDEVFSDQSKDGYAGYINGKTTQEAFYKYIKNLLSKLEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTDDVKQVVQELPGSPAIKKGILQSIKIVDELVKVMGHAPESIVIEMARENQTTNQGKRNSQQRYKRLEDGIKNLAKDLNGKILKEYPTDNQALQNERLFLYYLQNGKDMYTDEELDINQLSNYDIDHIIPQAFIKDDSLDNRVLTSSKDNRGKSDNVPSIEVVEKMKAFWKQLLDSKLISERKYNNLTKAERERDGLNELDKVGFIKRQLVETRQITKHVAQILDARFNTEVNEKGKKIRKVKIITLKSNLVSNFRKEFGLYKVREINDYHHAHDAYLNAVLAKAILKKYPKLEPEFVYGDYQKYDIKRYISKSKDPKDIDKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 193 - protein, 1372 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMSKIDESFFQRLDDSFLVPDDKRDSKYPIFGNLVEEKTYHDEFPTIYHLRKYLADSSKKADLRLVYLALAHMIKYRGHFLIEGEFNSKNNDIKKNFQEFLDSYNAIFESDLSLENSAQVEEIVKDKISKSAKRERVLKLFPDEKSTGLFSEFLKLIVGNQADFKKHFELEEKAPLQFSKDTYDEDLENLLGQIGDDFADLFLVAKKLYDAILLSGILTVTDPSTKAPLSASMIERYENHQKDLAALKQFIKANLPEKYDEVFSDQSKDGYAGYINGKTTQEAFYKYIKNLLSKLEGADYFLDKIEREDFLRKQRTFDNGSIPHQIHLQEMNAIIRRQGEHYPFLKENKEKIQQILTFRIPYYVGPLARGNRDFAWLTRNSDQAIRPWNFEEIVDKASSAEEFINKMTNYDLYLPEEKVLPKHSLLYETFAVYNELTKVKFIAEGLRDYQFLDSGQKKQIVNQLFKDKRKVTEKDIIHYLHTVDGYDGIELKGIEKQFNASLSTYHDLLKIIKDKEFMDDPKNEEILENIVHTLTIFEDREMIKQRLAQYASIFDEKVIKALTRRHYTGWGKLSAKLINGIYDKQSKKTILDYLIDDGEINRNFMQLIHDDGLSFKEIIQKAQVVGKTDDLKQVVQELPGSPAIKKGILQSIKIVDELVKVMGHAPESIVIEMARENQTTNQGKRNSQQRYKRIEDAIKNLSIDLNSKILKEYPTDNQALQNDRLFLYYLQNGKDMYTGEALDINQLSNYDIDHIIPQAFIKDDSLDNRVLTSSKDNRGKSDNVPSLEIVEKMKGFWQQLLDSKLISERKFNNLTKAERGGLDERDKVGFIKRQLVETRQITKHVAQILDARFNTEVNEKKQKIRTVKIITLKSNLVSNFRKEFGLYKVREINDYHHAHDAYLNAVVAKAILKKYPKLEPEFVYGDYQKYDIKRYISRSKDPKEVEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 194 - protein, 1372 aa, synthetic construct
MNKPYSIGLDIGTNSVGWAVITDDYKVPSKKMKVLGNTSKKYVKKNLLGALLFESGITAEGRRLKRTARRRYTRRRNRILYLQEIFSSEMDKIDESFFQRLDDSFLVPDDKRDSKYPIFGNLVEEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAQLKQFVRRNIPEKYDEVFADQSKNGYAGYIDGKTTQEEFYKYIKNALNKIEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKQSQKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDSLKNLAIGLDSKILKEHPTDNQALQNDRLFLYYLQNGKDMYTGKELDINQLSNYDIDHIIPQAFIKDDSLDNRVLTSSKDNRGKSDDVPSIEIVKARKGFWQQLLNSKLISERKFNNLTKAERGGLDERDKVGFIKRQLVETRQITKHVAQILDARFNTEVDENGKRIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTILKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 195 - protein, 1371 aa, synthetic construct
MKKYSIGLDIGTNSVGWAVVDDDYKVPAKKMRVFGDTDRSHIKKNLLGTLLFDSGETAESRRLKRTARRRYTRRRNRILYLQEIFAKEMAKVDESFFHRLDESFLTDDDKTFDSHPIFGNKAEEDAYHQKFPTIYHLRKHLADSTEKADLRLVYLALAHMIKFRGHFLIEGELNAENTDVQKLFAQFVGVYDRTFDDSHLSEITVDASSILTEKISKSRRLENLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFIKANKPELYHDIFKDETKNGYAGYIENGVKQDEFYKYLKNTLSKIEGSDYFLDKIEREDFLRKQRTFDNGSIPHQIHLQEMHAILRRQGDYYPFLKENQDRIEKILTFRIPYYVGPLARKDSRFAWANYHSDEPITPWNFDEVVDKEKSAEKFITRMTLNDLYLPEEKVLPKHSPVYETYTVYNELTKVKYVTEQGKATFFDANMKQEIFEHVFKENRKVTKDKFLNYLNKEFPEYRIQDLIGLDKENKSFNASLGTYHDLKKILDKSFLDDKTNEEIIEDIIQTLTLFEDRDMIRQRLQKYSDIFTKQQLKKLERRHYTGWGRLSYKLINGIRNKENNKTILDYLIDDGHANRNFMQLINDESLSFKTIIQEAQVVGDVDDIKAVVHDLPGSPAIKKGILQSVKIVDELVKVMGDNPDNIVIEMARENQTTNRGRTQSQQRLKKLQDSLKELGSNILNEEKPSYVEGKVENNHLQNDKLFLYYIQNGKDMYTGEELDIDHLSDYDIDHIIPQAFIKDDSIDNRVLTSSAKNRGKSDDVPSLDIVHDRKADWIRLYKSGLISKRKFDNLTKAERGGLTEADKAGFIKRQLVETRQITKHVAQILDARFNTERDENDKVIRDVKVITLKSNLVSQFRKDFQFYKVREINDYHHAHDAYLNAVVGTALLKKYPKLAPEFVYGEYKKYDIRKFITASGDKATAKYFFYSNLLNFFKTKVRYADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 196 - protein, 1373 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRKISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIEYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGKTILDYLIDDGVSNRNFMQLIHDDTLSFKKKIQKAQIIGDQDNIKQVVQSLPGSPAIKKGILQSIKIVDELVKVMGREPESIVVEMARENQYTNQGKSNSQQRLKRLEESLKELGSKILKENVPAKLSKIDNNALQNERLYLYYLQNGKDMYTGDDLDIDRLSNYDIDHIIPQAFLKDNSIDNKVLVSSASNRGKSDDVPSIEVVKARKTFWHQLLKSQLISQRKFDNLTKAERGGLTDDDKAGFIKRQLVETRQITKHVAQLLDSRFNTKRDDNDKVIREVKIITLKSSLVSQFRKDFKLYKVREINDYHHAHDAYLNAVVATAILKKYPKLEPEFVYGDYQKYDIRKYLSTKDNKDLGKATAKMFFYSNLMNFFKKEVRLADGTVVVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 197 - protein, 1373 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQDFLDSYNAIFESDLSLENSKQLEEIVKDKISKSAKKDRLLKLFPGEKNSGIFSEFLKLIVGNQADFRKYFNLDEKASLHFSKESYDEDLETLLGHIGDDYSDVFLKAKKLYDAILLSGILTVTDNETEAPLSSAMIMRYKEHEEDLALLKAYIRNISLETYNEVFKDDTKNGYAGYIDGKTNQEDFYVYLKKLLTGLEGADYFLEKINREDLLRKQRTFDNGSIPYQIHLQEMRAIIDKQAKFYPFLAKNKERIEKILTFRIPYYVGPLARGNSDFAWSIRKRNEKITPWNFEDVIDKESSAEAFINRMTSFDLYLPEEKVLPKHSLLYETFTVYNELTKVRFIAESMRDYQFLDSKQKKDIVRLYFKGKRKVTDKDIIDYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGKTILDYLIDDGVSNRNFMQLIHDDTLTFKKKIQKAQYIEDQDNIKQVVQSLPGSPAIKKGILQSIKIVDELVKVMGGRKPESIVVEMARENQYTNQGKSNSQQRLKRLEESLKELGSKILKENVPAKLSKIDNNALQNERLYLYYLQNGKDMYTGDDLDIDRLSNYDIDHIIPQAFLKDNSIDNKVLVSSASNRGKSDDVPSLDVVKKRKTFWHQLLKSQLISQRKFDNLTKAERGGLTDDDKAGFIKRQLVETRQITKHVAQLLDSRFNTKRDDNDKVIRDVKIITLKSSLVSQFRKEFGLYKVREINDYHHAHDAYLNAVVATAILKKYPKLEPEFVYGEYKKYDVRKFIAKSDKSLGKATAKMFFYSNLMNFFKKEVRLADGTVVVRPVVEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 198 - protein, 1374 aa, synthetic construct
MKKYSIGLDIGTNSVGWAVVDDDYKVPAKKMRVFGDTDRSHIKKNLLGTLLFDSGETAESRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGQLNAENTDVQTLFNDFVEVYDKTVEESHLSEITVDALSILTEKVSKSRRLENLIKYYPTEKKNTLFGNLIALALGLQPNFKTNFKLSEDAKLQFSKDTYEEDLEELLGKIGDDYADLFTSAKNLYDAILLSGILTVDDNSTKAPLSASMIKRYVEHHEDLEKLKDFIRANKPDFYHDIFKDENKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFAWAEYHLDEKITPWNFDKVIDKEKSAEKFITRMTSNDLYLPEEKVLPKHSHVYETYAVYNELTKIKYVNEQGEESFFDANMKQEIFDHVFKENRKVTKEKLLNYLNKEFPEYRIQDLIGLDKENKSFNASLGTYHDLKKILDKSFLDDKTNEQIIEDIIQTLTLFEDRDMIRQRLQKYSDIFTKQQLKKLERRHYTGWGRLSYKLINGIRNKENNKTILDFLIDDGHANRNFMQLINDDSLSFKTIIQEAQVVGDVDDIEAVVHDLPGSPAIKKGILQSVKIVDELVKVMGHNPDNIVIEMARENQTTNRGRSQSQQRLKKLQESLKELGSNILNEEKPSYIEDKVENSQLQNDRLFLYYIQNGKDMYTGDELDIDHLSDYDIDHIIPQAFIKDDSIDNRVLTSSAKNRGKSDDVPSLDIVRDRKADWIRLYKSGLISKRKFDNLTKAERGGLTEADKAGFIKRQLVETRQITKHVAQILDARFNTKRDENDKVIRDVKVITLKSNLVSQFRKDFGFYKVREINDYHHAHDAYLNAVVGTALLKKYPKLAPEFVYGEYKKYDVRKLIVQSDQKYGKATAKMFFYSNLMNFFKKEVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 199 - protein, 1372 aa, synthetic construct
MKKPYSIGLDIGTNSVGWAVVTDDYKVPAKKMKVLGNTDKSHIKKNLLGALLFDSGETAEGTRLKRTARRRYTRRRNRILYLQEIFAKEMAKVDESFFQRLEESFLTDDDKTFDSHPIFGNKAEEDVYHQKFPTIYHLRKHLADSPEKADLRLVYLALAHMIKFRGHFLIEGQLNAENTDVQTLFNDFVEVYDKTVEESHLSEITVDALSILTEKVSKSRRLENLIKYYPTEKKNTLFGNLIALALGLQPNFKTNFKLSEDAKLQFSKDTYEEDLEELLGKIGDEYADLFTSAKNLYDAILLSGILTVDDNSTKAPLSASMLKRYVEHHEDLEKLKEFIKANKSELYHDIFKDKNKNGYAGYIENGVKQDEFYKYLKNTLSKIEGSDYFLDKIEREDFLRKQRTFDNGSIPHQIHLQEMHAILRRQGEYYPFLKENQAKIEKILTFRIPYYVGPLARKDSRFAWANYHSDEPITPWNFDEVVDKEKSAEKFITRMTLNDLYLPEEKVLPKHSHVYETYTVYNELTKIKYVNEQGKATFFDANMKQEIFEHVFKENRKVTKEKFLNYLNKEFPEYRIQDLIGLDKENKSFNASLGTYHDLKKILDKSFLDDKTNEQIIEDIIQTLTLFEDRDMIRQRLQKYSDIFTKQQLKKLERRHYTGWGRLSYKLINGIRNKENNKTILDYLIDDGYANRNFMQLINDDTLPFKQIIQEAQVVGDVDDIEAVVHDLPGSPAIKKGILQSVKIVDELVKVMGHNPDNIVIEMARENQTTNRGRSQSQQRLKKLQESLKELGSNILNEEKPSYIEDKVENSHLQNDKLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTEADKAGFIKRQLVETRQITKHVAQILDSRFNTKRDENDKVIRDVKVITLKSNLVSQFRKDFQFYKVREINDYHHAHDAYLNAVVGTALLKKYPKLAPEFVYGEYKKYDIRKFISSSSDKATAKYFFYSNLLNFFKTKVRYADGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 200 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVEEKAYHDEFPTIYHLRKYLADSSKKADLRLVYLALAHMIKYRGHFLIEGEFNSKNNDIKKNFQEFLDSYNAIFESDLSLENSAQVEEIVKDKISKSAKRERVLSLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAQLKQFVRRNLPEKYAEVFADQSKNGYAGYIDGKTTQEEFYKYLKEELTGVKGADYFLEKIKREDFLRKQRTFDNGSIPYQVHLTEMKAIIHRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDSLKNLASGLDSNILKENPTDNVQLQNDRLFLYYLQNGRDMYTGKPLDINQLSNYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNTEVDDKGKRIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 201 - protein, 1380 aa, synthetic construct
MKKPYSIGLDIGTNSVGWAVITDDYKVPAKKMKVLGNTDRSHIKKNLIGALLFDAGNTAEDRRLKRTARRRYTRRRNRILYLQEIFAEEMNKIDESFFHRLDDSFLVPEDKRGSKYPIFATLQEEKEYHKQFPTIYHLRKQLAESNEKADLRLVYLALAHMIKYRGHFLIDDPKFKVQNNDIQGLFEKFVEEYDNVQETSLSKIKLNVTEILTAKIPKSEKQEQLLKNYPSEKKNTLFGNLIGLALGLTPNFKTNFSLENDAKLQISSESYEEDLGSLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDLLRKQRTFDNGTIPYQVHLEEMKAILQNQGEYYPFLKENKEKIQQILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTNKTILDFLIDDDKINRNFMQLINDDGLSFKDIIQKAQVVGKIDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVNEKNQKIRKVKIITLKSNLVSNFRKEFGLYKVREINDYHHAHDAYLNAVVAKAILKKYPKLEPEFVYGDYQKYDLKRYISRSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 202 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDESKNGYAGYIENGVKQDEFYKYLKETLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMDFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHQHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 203 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHHKDLALLKNLIKQNLTQEKYDEVFSDESKNGYAGYISGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIPRKTEWDPKKYGGFDSPIVAYSVLVVAKVEKGKSKKLKPVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKILSAYNKHRDKPIREQAENIINLFTFTNLGAPAAFKFFDTDIDRKRYTSTKEVLDATLIHQSITGLYETRIDLSQLGGD

SEQ ID NO: 204 - protein, 1380 aa, synthetic construct
MKKPYSIGLDIGTNSVGWAVVTDDYKVPSKKMKVLGNTDKSHIKKNLLGALLFESGETAEGRRLKRTARRRYTRRRNRILYLQEIFAEEMNKIDESFFHRLDDSFLVPEDKRGSKYPIFATLQEEKEYHKQFPTIYHLRKQLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDFLRKQRTFDNGTIPYQVHLTEMRAIIHRQGEHYPFLQENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDAKNEEILENIVHTLTIFEDREMIKQRLAQYDSLFDEKVIKALTRRHYTGWGKLSAKLINGIYDKQSKKTILDYLIDDDKINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEPLDINQLSSYDIDHIVPQAFIKDDSLDNRVLTSSKDNRGKSDNVPSLEVVQKRKAFWQQLLDSKLISEHKFNNLTKAERGGLDERDKVGFIKRQLVETRQITKHVAQILDARFNTEVNEKKQKIRSVKIITLKSNLVSNFRKEFRLYKVREINDYHHAHDAYLNAVVAKAILKKYPKLEPEFVYGDYQKYDIKRYISRSKDPKEVEKATQKYFFYSNLLNFFKEEVHYADGTIIKRENIEYSKDTGEIAWNKEKDFATVRKVLSCPQVNIVKKTEVQTGGFSKESILPKRNSDKLIPRKTEWDPKKYGGFDSPTVAYSVLVVAKVEKGKSKKLKSVKELVGITIMERSSFEKDPVDFLEAKGYKEVRKDLIIKLPKYSLFELENGRRRLLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFDTTIDRKRYTSTKEVLDATLIHQSITGLYETRIDLSQLGGD

SEQ ID NO: 205 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDESKNGYAGYIENGVKQDEFYKYLKETLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMDFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIPRKTEWDPKKYGGFDSPIVAYSVLVVAKVEKGKSKKLKPVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKILSAYNKHRDKPIREQAENIINLFTFTNLGAPAAFKFFDTDIDRKRYTSTKEVLDATLIHQSITGLYETRIDLSQLGGD

SEQ ID NO: 206 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHHKDLALLKNLIKQNLTQEKYDEVFSDESKNGYAGYISGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 207 - protein, 1380 aa, synthetic construct
MKKPYSIGLDIGTNSVGWAVVTDDYKVPAKKMRVLGDTDRSHIKKNLIGALLFDAGNTAEDRRLKRTARRRYTRRRNRILYLQEIFAEEMNKVDESFFHRLDDSFLVPEDKRGSKYPIFATLQEEKEYHKQFPTIYHLRKQLAESNEKADLRLIYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDFLRKQRTFDNGTIPYQVHLTEMRAILHRQGEYYPFLQENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVVKALARRHYTGWGKLSAKLINGIYDKQSKKTILDYLIDDGKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKEHPTDNIQLQNDRLFLYYLQNGKDMYTGEPLDINQLSSYDIDHIVPQAFIKDDSLDNRVLTSSKDNRGKSDNVPSLEVVQKRKAFWQQLLDSKLISERKFNNLTKAERGGLDERDKVGFIRRQLVETRQITKHVAQILDARFNTEVNEKNQKIRTVKIITLKSNLVSNFRKEFGLYKVREINDYHHAHDAYLNAVLAKAILKKYPKLEPEFVYGDYQKYDLKRYISRSRDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 208 - protein, 1380 aa, synthetic construct
MKKSYSIGLDIGTNSVGWAVVNDDYKVPAKKMRVFGDTDRSHIKKNLLGTLLFDSGETAEGRRLKRTARRRYTRRRNRILYLQEIFAEEMNKIDESFFHRLDDSFLVPEDKRGSKYPIFATLAEEKEYHKQFPTIYHLRKKLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKNILNNIKGADYFLEKIEREDLLRKQRTFDNGTIPYQVHLAEMRAILHRQGDYYPFLKENREKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGNTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKEHPTDNIQLQNDRLFLYYLQNGKDMYTGESLDINQLSSYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVNEKGQKIRKVKIITLKSNLVSNFRKEFGLYKVREINDYHHAHDAYLNAVVAKAILKKYPKLEPEFVYGDYQKYDIKRYISKSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIPRKTEWDPKKYGGFDSPTVAYSVLVVAKVEKGKSKKLKSVKELVGITIMERSSFEKDPVDFLEAKGYKEVRKDLIIKLPKYSLFELENGRRRLLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFDTTIDRKRYTSTKEVLDATLIHQSITGLYETRIDLSQLGGD

SEQ ID NO: 209 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHQKDLALLKNLIKKNLTQEKYDEVFSDESKNGYAGYINGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKQQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKIMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFAIVRKVLSCPQVNIVKKTEVQTGGFSKESILPKRNSDKLIPRKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSERVILADANLDKVLSAYNNHRDKPIREQAENIIHLFTLTNLGAPAAFKFFDTTIDRKRYTSTKEILNATLIHQSITGLYETRIDLSQLGGD

SEQ ID NO: 210 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDESKNGYAGYIENGVKQDEFYKYLKETLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMDFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 211 - protein, 1380 aa, synthetic construct
MKKPYSIGLDIGTNSVGWAVVTDDYKVPAKKMKVLGDTDRSHIKKNLLGALLFDSGETAEGRRLKRTARRRYTRRRNRILYLQEIFAEEMNKVDESFFHRLDDSFLVPEDKRGSKYPIFATLEEEKEYHKQFPTIYHLRKKLAESNEKADLRLIYLALAHMIKYRGHFLIDDPKFKVQNNDIQGLFEKFVEEYDNVQETSLSKIKLNVTEILTAKIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKSNLPEKYDEVFSDDSKNGYAGYVGVDSKVRKRNGKLATEEEFYKYLKDILNNVKGADYFLEKIKREDFLRKQRTFDNGVIPYQVHLTEMKAILQHQGEYYPFLQENKEKIQQILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGDTILDYLIDDDKINRNFMQLINDDGLSFKEIIQKAQVVGKTDDVKQVVQELPGSPAIKKGILQSIKLVDELVKVMGHAPESIVIEMARENQTTARGKKNSQQRYKRIEDALKNLAPGLDSNILKEHPTDNIQLQNDRLFLYYLQNGRDMYTGEPLDINQLSNYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVNEKNQKIRKVKIITLKSNLVSNFRKEFGLYKVREINDYHHAHDAYLNAVVAKAILKKYPKLEPEFVYGDYQKYDLKRYISRSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 212 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 213 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDESKNGYAGYIENGVKQDEFYKYLKETLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMDFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 214 - protein, 1380 aa, synthetic construct
MKKPYSIGLDIGTNSVGWAVVTDDYKVPAKKMRVLGDTDRSHIKKNLIGALLFDAGNTAEDRRLKRTARRRYTRRRNRILYLQEIFAEEMNKVDESFFHRLDDSFLVPEDKRGSKYPIFATLQEEKEYHKQFPTIYHLRKQLAESNEKADLRLIYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDFLRKQRTFDNGTIPYQVHLTEMRAILHRQGEYYPFLQENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVVKALARRHYTGWGKLSAKLINGIYDKQSKKTILDYLIDDGKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKEHPTDNIQLQNDRLFLYYLQNGKDMYTGEPLDINQLSSYDIDHIVPQAFIKDDSLDNRVLTSSKDNRGKSDNVPSLEVVQKRKAFWQQLLDSKLISERKFNNLTKAERGGLDERDKVGFIRRQLVETRQITKHVAQILDARFNTEVNEKNQKIRTVKIITLKSNLVSNFRKEFGLYKVREINDYHHAHDAYLNAVLAKAILKKYPKLEPEFVYGDYQKYDLKRYISRSRDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIPRKTEWDPKKYGGFDSPTVAYSVLVVAKVEKGKSKKLKSVKELVGITIMERSSFEKDPVDFLEAKGYKEVRKDLIIKLPKYSLFELENGRRRLLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFDTTIDRKRYTSTKEVLDATLIHQSITGLYETRIDLSQLGGD

SEQ ID NO: 215 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDESKNGYAGYIENGVKQDEFYKYLKETLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMDFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIPRKTEWDPKKYGGFDSPTVAYSVLVVAKVEKGKSKKLKSVKELVGITIMERSSFEKDPVDFLEAKGYKEVRKDLIIKLPKYSLFELENGRRRLLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFDTTIDRKRYTSTKEVLDATLIHQSITGLYETRIDLSQLGGD

SEQ ID NO: 216 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHHKDLALLKNLIKQNLTQEKYDEVFSDESKNGYAGYISGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 217 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHHKDLALLKNLIKQNLTQEKYDEVFSDESKNGYAGYISGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDSTLIHQSITGLYETRIDLSQLGGD

SEQ ID NO: 218 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDESKNGYAGYIENGVKQDEFYKYLKETLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMDFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 219 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLSAENTNVQTLFNDFVEVYDKTVEESHLSEITIDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNSTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENRKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFSHFHGHKENKATAKKFFYSNIMALFKKDVEYSDDTGEMVWNKEKDFATVRKVLSCPQVNIVKKTEVQTGGFSKESILPKRNSDKLIPRKKDWDPKKYGGFDSPTVAYSVLVVAKVEKGKSKKLKPVKELIGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSERVILADANLDKVLSAYNKHRDKPIREQAENILHLFTLTNLGAPAAFKFFDTTIDRKRYTSTKEVLDATLIHQSITGLYETRIDLSQLGGD

SEQ ID NO: 220 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDESKNGYAGYIENGVKQDEFYKYLKETLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMDFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIPRKKGWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFNTDIDRKRYTSTKEILDATLIHQSITGLYETRIDLSQLGGD

SEQ ID NO: 221 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDESKNGYAGYIENGVKQDEFYKYLKETLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMDFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDSTLIHQSITGLYETRIDLSQLGGD

SEQ ID NO: 222 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHQKDLALLKNLIKQNLTQEKYDEVFSDESKNGYAGYINGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFAIVRKVLSCPQVNIVKKTEVQTGGFSKESILPKRNSDKLIPRKNNWDPKKYGGFDSPTVAYSVLVVAKVEKGKSKKLKPVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSERVILADANLDKVLSAYNNHRDKPIREQAENIIHLFTLTNLGAPAAFKFFDTTIDRKRYTSTKEILDATLIHQSITGLYETRIDLSKLGGD

SEQ ID NO: 223 - protein, 1379 aa, synthetic construct
MKKSYSIGLDIGTNSVGWSVVTDDYKVPAKKMKVFGNTDKKYIKKNLLGTLLFDNGETAEGRRLKRTARRRYTRRRNRILYLQEIFAKEMSKIDESFFQRLEESFLTDDDKNFDSHPIFGNKAEEDAYHKQFPTIYHLRKHLADSSEKADLRLVYLALAHMIKFRGHFLIEGQLKAENTNVQTLFNDFVEVYDKTVEESHLAEITVDALSILTEKVSKSRRLENLLKYYPTEKKNTLFGNLIALSLGLQPNFKTNFKLSEDAKLQFSKDTYEEDLEELLGKIGDEYADLFTSAKNLYDAILLSGILTVDDKSTKAPLSASMLKRYVEHHEDLEKLKDFVKANKPELYHDIFKDETKNGYAGYIENGVKQDEFYKYLKNTLSKIAGSDYFLDKIEREDFLRKQRTFDNGSIPHQVHLQEMRAILRRQGEYYPFLKENQAKIEKILTFRIPYYVGPLARKDSRFAWAEYHSDEKITPWNFDKVIDKESSARAFIEHMTNHDLYLPEEKVLPKHSPLYEKYTVYNELTKVKYVTEQGKSSFFDANMKQEIFEHVFKKNRKVTKDKFLNYLNKEFPEYRIHDLIGLDKENKSFNASLGTYHDLKKILDKSFLDNKENEEIIEDVVLTLTLFEDRDMIRQRLQKYSDIFTKDQLKKLERRHYTGWGRLSYKLINGIRDKQSNKTILDYLLEDDGVKKNINRNFMQLINDDSLSFKTIIQEAQVIGDIDDIKAVVHDLPGSPAIKKGILQSVKIVDELVKIMGHNPDNIVIEMARENQTTNRGRSQSQQRLKKLQESLKELGSNILNEEKPSYIEDKVENSHLQNDRLFLYYIQNGKDMYTGDELDIDHLSDYDIDHIIPQAFIKDNSIDNRVLTSSAKNRGKSDDVPSLDIVRERKADWIRLYKAGLISKRKFDNLTKAERGGLTENDKAGFIKRQLVETRQITKHVAQILDARFNTKRDENDKVIRDVKIITLKSNLVSQFRKEFGFYKIREVNDYHHAHDAYLNAVVGTALIKKYPKLESEFVYGDYKVYDVRKMIAKSEQEIGKATAKRFFYSNIMNFFKTEIKLANGEIRKRPLIETNEETGEVVWNKEKDFAIVRKVLSCPQVNIVKKTEVQTGAFTKESILPKRNSDKLIARKKNWDPKKYGGFDSPIVAYSVLVVAKVEKGKSKKLKPVKELVGITIMEQKSFEKDPIDFLEAKGYKEVRKDLIIKLPKYSLFELENGRKRMLASAGELQKGNELALPSKYINFLYLASHYEKLKGSPEDNEQKQLFVEQHKHYLDEIIEQISEFSERVILADANLDKVLSAYNNHRDKPIREQAENIIHLFTLTNLGAPAAFKFFDTTIDRKRYTSTKEVLDATLIHQSITGLYETRIDLSQLGGD

SEQ ID NO: 224 - protein, 1380 aa, synthetic construct
MKKSYSIGLDIGTNSVGWAVVNDDYKVPAKKMRVFGDTDRSHIKKNLLGTLLFDSGETAEGRRLKRTARRRYTRRRNRILYLQEIFAEEMNKIDESFFHRLDDSFLVPEDKRGSKYPIFATLAEEKEYHKQFPTIYHLRKKLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKNILNNIKGADYFLEKIEREDLLRKQRTFDNGTIPYQVHLAEMRAILHRQGDYYPFLKENREKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGNTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKEHPTDNIQLQNDRLFLYYLQNGKDMYTGESLDINQLSSYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVNEKGQKIRKVKIITLKSNLVSNFRKEFGLYKVREINDYHHAHDAYLNAVVAKAILKKYPKLEPEFVYGDYQKYDIKRYISKSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIPRKTEWDPKKYGGFDSPIVAYSVLVVAKVEKGKSKKLKPVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKILSAYNKHRDKPIREQAENIINLFTFTNLGAPAAFKFFDTDIDRKRYTSTKEVLDATLIHQSITGLYETRIDLSQLGGD

SEQ ID NO: 225 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDSYDEDLEELLGKIGDDYADLFVAAKNLYDAILLSGILTVTDPTTKAPLSASMIDRYEKHHKDLALLKNLIKKNLTQEKYDEVFSDESKNGYAGYINGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVIAKVEKGKSKKLKPVKELVGITIMERSSFEKNPIDFLEAKGYKEVREDLIIKLPKYSLFELENGRKRMLASAGELQKGNELALPSKYVNFLYLASHYEKLKGSPEDNEQKRLFVEQHKHYLDEIVEQISEFSERVILADANLDKILSAYNKHRDKPIREQAENIINLFTLTNLGAPAAFKFFDTTIDRKRYTSTKEILDATLIHQSITGLYETRIDLSQLGGN

SEQ ID NO: 226 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHHKDLALLKNLIKQNLTQEKYDEVFSDESKNGYAGYISGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDSTLIHQSITGLYETRIDLSQLGGD

SEQ ID NO: 227 - protein, 1380 aa, synthetic construct
MKKPYSIGLDIGTNSVGWAVITDDYKVPSKKMKVLGNTNKSHIKKNLLGTLLFDSGETAEGRRLKRTARRRYTRRRNRILYLQEIFAEEMNKVDESFFHRLDDSFLVPEDKRGSKYPIFATLQEEKEYHKQFPTIYHLRKQLAESNEKADLRLVYLALAHMIKYRGHFLIDDPKFKVQNNDIQGLFEKFVEEYDNVQETSLSKIKLNVTEILTAKIPKSEKQEQLLKNYPSEKKNTLFGNLIGLALGLTPNFKTNFSLENDAKLQISSESYEEDLGSLLALIGENFIELFSAVKNLSDGILLAGIVSDESPHAPLSAKMVIRFKEHEEDLAALKHFIKANLPEKYDEVFSDDSKNGYAGYVGVDSKVRKRNGKLATEEEFYKYLKDILNNVKGADYFLEKIKREDFLRKQRTFDNGTIPYQVHLAEMRAILHRQGDYYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDDPKNEEILENIIHTLTIFEDREMIKQRLAQYDSLFDEKVIKALTRRHYTGWGKLSAKLINGIYDKQSKKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEPLDINQLSSYDIDHIVPQAFIKDDSLDNRVLTSSKDNRGKSDNVPSIEVVQKRKAFWQQLLDSKLISERKFNNLTKAERGGLDERDKVGFIRRQLVETRQITKHVAQILDARFNTEVNEKNQRIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 228 - protein, 1380 aa, synthetic construct
MKKSYSIGLDIGTNSVGWAVVNDDYKVPAKKMRVFGDTDRSHIKKNLLGTLLFDSGETAEGRRLKRTARRRYTRRRNRILYLQEIFAEEMNKIDESFFHRLDDSFLVPEDKRGSKYPIFATLAEEKEYHKQFPTIYHLRKKLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKNILNNIKGADYFLEKIEREDLLRKQRTFDNGTIPYQVHLAEMRAILHRQGDYYPFLKENREKIEKILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGNTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKEHPTDNIQLQNDRLFLYYLQNGKDMYTGESLDINQLSSYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVNEKGQKIRKVKIITLKSNLVSNFRKEFGLYKVREINDYHHAHDAYLNAVVAKAILKKYPKLEPEFVYGDYQKYDIKRYISKSKDPKEIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 229 - protein, 1380 aa, synthetic construct
MKKPYSIGLDIGTNSVGWAVITDDYKVPSKKMKVLGNTDKSHIKKNLIGALLFDSGNTAEDRRLKRTARRRYTRRRNRILYLQEIFATEMNKVDESFFHRLDDSFLVPEDKRGSKYPIFGTLEEEKEYHKQFPTIYHLRKQLAESNEKADLRLVYLALAHMIKYRGHFLIDDPKFKVQNNDIQGLFEKFVEEFDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDFLRKQRTFDNGTIPYQVHLTEMKAILHRQGEYYPFLKENKEKIQQILTFRIPYYVGPLARGNRDFAWLTRNSDQAIRPWNFEEVVDQASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDAKNEEILENIVHTLTIFEDREMIKQRLAQYDSLFDEKVIKALARRHYTGWGKLSAKLINGICDKQTGDTILDYLIDDDKINRNFMQLIHDDGLSFKEIIQKAQVFGKTDDVKQVVQELPGSPAIKKGILQSIKIVDELVKVMGHAPESIVIEMARENQTTARGKKNSQQRYKRIEDSLKILASGLNSKILKEHPTDNQALQNDRLFLYYLQNGKDMYTGEALDINQLSSYDIDHIIPQAFIKDDSLDNRVLTSSKDNRGKSDNVPSIEVVQRRKAFWQQLLDSKLISERKFNNLTKAERGGLDERDKVGFIKRQLVETRQITKHVAQILDARFNTEVNEKNQKIRTVKIITLKSNLVSNFRKEFGLYKVREINDYHHAHDAYLNAVVAKAILKKYPKLEPEFVYGDYQKYDLKRYISRSKDPKEVEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 230 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 231 - protein, 1382 aa, synthetic construct
MKKPYSIGLDIGTNSVGWAVVTDDYKVPAKKMKVLGNTDKSHIKKNLLGALLFDSGETAEGRRLKRTARRRYTRRRNRILYLQEIFAEEMNKIDESFFHRLDDSFLVPEDKRGSKYPIFATLEEEKEYHKKFPTIYHLRKHLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDLLRKQRTFDNGTIPYQVHLSEMKAIIHRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLIHDDGLSFKEIIQKAQVFGKTDDVKQVVQELPGSPAIKKGILQSIKIVDELVKVMGHAPESIVIEMARENQTTARGKKNSQQRYKRIEDSLKNLASGLDSNILKENPTDNVQLQNDRLFLYYLQNGKDMYTGEALDINQLSNYDIDHIIPQAFIKDDSLDNRVLTSSKDNRGKSDNVPSIEVVEKMKAFWQQLLDSKLISERKYNNLTKAERERGGLNELDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIPRKTEWDPKKYGGFDSPIVAYSVLVVAKVEKGKSKKLKPVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKILSAYNKHRDKPIREQAENIINLFTFTNLGAPAAFKFFDTDIDRKRYTSTKEVLDATLIHQSITGLYETRIDLSQLGGD

SEQ ID NO: 232 - protein, 1380 aa, synthetic construct
MKKPYSIGLDIGTNSVGWAVITDDYKVPAKKMKVLGNTDKSHIKKNLLGALLFDSGNTAEDRRLKRTARRRYTRRRNRILYLQEIFAEEMNKIDESFFHRLDDSFLVPEDKRGSKYPIFATLEEEKEYHKQFPTIYHLRKKLAESNEKADLRLIYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKEILNNVKGADYFLEKIKREDFLRKQRTFDNGTIPYQVHLAEMRAILHRQGDYYPFLKDNKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKQSNKTILDYLIDDDKINRNFMQLINDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGESLDINQLSNYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVNEKNQKIRKVKIITLKSNLVSNFRKEFRLYKVREINDYHHAHDAYLNAVVAKAILKKYPKLEPEFVYGDYQKYDIKRYISKSKDPKDIEKATQKYFFYSNLLNFFKEEVHYADGTIVKRENVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 233 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHQHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 234 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDESKNGYAGYIENGVKQDEFYKYLKETLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMDFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 235 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDESKNGYAGYIENGVKQDEFYKYLKETLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMDFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHQHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 236 - protein, 1382 aa, synthetic construct
MKKPYSIGLDIGTNSVGWAVVTDDYKVPAKKMKVLGNTDKSHIKKNLLGALLFEGGETAEGRRLKRTARRRYTRRRNRILYLQEIFATEMNKVDESFFHRLDDSFLVPEDKRGSKYPIFGTLEEEKEYHKQFPTIYHLRKQLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDFLRKQRTFDNGTIPYQVHLQEMKAILHRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSQKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNVQLQNDRLFLYYLQNGRDMYTGKPLDINQLSNYDIDHIIPQAFIKDDSLDNRVLTSSKDNRGKSDNVPSIEVVEKMKAFWQQLLDSKLISERKYNNLTKAERERGGLNELDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIPRKTEWDPKKYGGFDSPTVAYSVLVVAKVEKGKSKKLKSVKELVGITIMERSSFEKDPVDFLEAKGYKEVRKDLIIKLPKYSLFELENGRRRLLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFDTTIDRKRYTSTKEVLDATLIHQSITGLYETRIDLSQLGGD

SEQ ID NO: 237 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHHKDLALLKNLIKQNLTQEKYDEVFSDESKNGYAGYISGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 238 - protein, 1354 aa, synthetic construct
MKKSYTIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDTYHDEFPTIYHLRQYLADSPQKADLRLVYLALAHMIKFRGHFLIEGQLNAENTNVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNSTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEHYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFSHFHGHKENKATAKKFFYSNIMALFKKDVEYSDDTGEMVWNKEKDFATVRKVLSCPQVNIVKKTEVQTGGFSKESILPKRNSDKLIPRKKNWDPKKYGGFDSPTVAYSVLVIAKVEKGKSKKLKPVKELIGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSERVILADANLDKVLSAYNNHRDKPIREQAENIIHLFTLTNLGAPAAFKFFDTTIDRKRYTSTKEVLDATLIHQSITGLYETRIDLSQLGGD

SEQ ID NO: 239 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDSTLIHQSITGLYETRIDLSQLGGD

SEQ ID NO: 240 - protein, 1382 aa, synthetic construct
MKKPYSIGLDIGTNSVGWAVVTDDYKVPAKKMKVLGNTDKSHIKKNLLGALLFDSGNTAEDRRLKRTARRRYTRRRNRILYLQEIFAEEMNKVDESFFHRLDDSFLVPEDKRGSKYPIFGTLEEEKEYHKQFPTIYHLRKQLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGSLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKEILNNLKGADYFLEKIKREDLLRKQRTFDNGTIPYQVHLTEMKAIIHRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIVKRENIEYSKDTGEIAWNKEKDFATVRKVLSCPQVNIVKKTEVQTGGFSKESILPKRNSDKLIPRKTEWDPKKYGGFDSPTVAYSVLVVAKVEKGKSKKLKSVKELVGITIMERSSFEKDPVDFLEAKGYKEVRKDLIIKLPKYSLFELENGRRRLLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFDTTIDRKRYTSTKEVLDATLIHQSITGLYETRIDLSQLGGD

SEQ ID NO: 241 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 242 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDETKNGYAGYIENGVKQDEFYKYLKETLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMNFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIPRKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSERVILADANLDKVLSAYNKHRDKPIREQAENIIHLFTLTNLGAPAAFKFFDTTIDRKRYTSTKEVLDATLIHQSITGLYETRIDLSQLGGD

SEQ ID NO: 243 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTNVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNSTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEHYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIKEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDRLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATIRKVLSCPQVNIVKKTEVQTGGFSKESILPKRNSDKLIPRKKNWDPKKYGGFDSPTVAYSVLVVAKVEKGKSKKLKPVKELIGITIMERNSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSERVILADANLDKVLSAYNNHRDKPIREQAENIIHLFTLTNLGAPAAFKFFDTTIDRKRYTSTKEILDATLIHQSITGLYETRIDLSQLGGD

SEQ ID NO: 244 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 245 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKAKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDSTLIHQSITGLYETRIDLSQLGGD

SEQ ID NO: 246 - protein, 1382 aa, synthetic construct
MKKPYSIGLDIGTNSVGWAVVTDDYKVPAKKMKVLGNTDKSHIKKNLLGALLFDSGNTAEDRRLKRTARRRYTRRRNRILYLQEIFAEEMNKVDESFFHRLDDSFLVPEDKRGSKYPIFGTLEEEKEYHKQFPTIYHLRKQLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGSLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKEILNNLKGADYFLEKIKREDLLRKQRTFDNGTIPYQVHLTEMKAIIHRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 247 - protein, 1382 aa, synthetic construct
MKKPYSIGLDIGTNSVGWAVVTDDYKVPAKKMKVLGNTDKSHIKKNLLGALLFEGGETAEGRRLKRTARRRYTRRRNRILYLQEIFATEMNKVDESFFHRLDDSFLVPEDKRGSKYPIFGTLEEEKEYHKQFPTIYHLRKQLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDFLRKQRTFDNGTIPYQVHLQEMKAILHRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSQKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNVQLQNDRLFLYYLQNGRDMYTGKPLDINQLSNYDIDHIIPQAFIKDDSLDNRVLTSSKDNRGKSDNVPSIEVVEKMKAFWQQLLDSKLISERKYNNLTKAERERGGLNELDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 248 - protein, 1368 aa, synthetic construct
MDKKYSIGLDIGTNSVGWAVITDDYKVPAKKMKVLGNTDKRTIKKNLLGALLFDSGETAEATRLKRTARRRYTRRKNRLRYLQEIFSKEMSNVDANFFYRLEDSFLVPEDKQQERHPIFGNLVEEIEYHKEFPTIYHLRKQLADSKEKADLRLIYLALAHMIKYRGHFLFEGDLKSENTDVQRLFKDFVEVYDKTVEGSYLSENLTNVTDVLVEKISKSRRLENILHYFPNEKKNGLFGNFLALALGLQPNFKNNFDLAEEAKLQISKDTYEEELEVLLAQIGDNYAELFIATKELYDGILLAGILTVTDSSTKAPLSASMIERYENHQGDLAKLKAFIRRFCKETYDEVFSDEVKDGYAGYIEGKTSQEDFYVHLKKLLANLEGADYFLEKINREDLLRKQRTFDNGSIPYQIHLVEMRAILDKQAKFYPFLAKNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLMGLDKENKAFNASYGTYHDLRKILDKDFLDNSDNEKILEDIVLTLTLFEDREMIRKRLEKYKDIFTEKQRKQLERRHYTGWGRLSAKLIHGIRNKESRKTILDYLIDDGYSNRNFMQLINDDTLTFKEEIAKAQVVGETDSLKQFISELAGSPAIKKGILQTVKIVDELVKVMGHKPENIVIEMARENQTTQKGQKNSQERMKRIEEGIKELGSQILKEHPVENTQLQNEKLYLYYLQNGRDMYVDQELDINRLSDYDIDHIIPQAFIKDDSIDNRVLTSSKDNRGKSDNVPSEDVVKKMKNYWRQLLNAKLISQRKFDNLTKAERGGLSELDKVGFIKRQLVETRQITKHVAQILDSRMNTKYDENDKLIRDVKIITLKSKLVSDFRKDFQFYKVREINNYHHAHDAYLNAVVGTALIKKYPKLESEFVYGDYKVYDVQKMIAKSEQEIGKATAKFFFYSNIMNFFKTEITLANGEIRKRPMIETNEETGEIVWDKGRDFATVRKVLCMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDSTLIHQSITGLYETRIDLSQLGGD

SEQ ID NO: 249 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHQHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 250 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKAKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 251 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKAKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIPRKTEWDPKKYGGFDSPTVAYSVLVVAKVEKGKSKKLKSVKELVGITIMERSSFEKDPVDFLEAKGYKEVRKDLIIKLPKYSLFELENGRRRLLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFDTTIDRKRYTSTKEVLDATLIHQSITGLYETRIDLSQLGGD

SEQ ID NO: 252 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKAKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHQHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 253 - protein, 1380 aa, synthetic construct
MKKPYSIGLDIGTNSVGWAIVDDDYKVPAKKMRVFGDTDRSHIKKNLLGTLLFDSGETAESRRLKRTARRRYTRRRNRILYLQEIFAEEMNKVDDSFFHRLEDSFLVEEDKQGSKYPIFGTLEEEKEYHKQFPTIYHLRKQLAESNEKADLRLIYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDFLRKQRTFDNGSIPYQVHLTEMKAILQRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSIFDEKVIKALTRRHYTGWGKLSAKLINGICDKKTGKTILDYLIDDGKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEPLDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQKIREVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIPRKTEWDPKKYGGFDSPTVAYSVLVVAKVEKGKSKKLKSVKELVGITIMERSSFEKDPVDFLEAKGYKEVRKDLIIKLPKYSLFELENGRRRLLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFDTTIDRKRYTSTKEVLDATLIHQSITGLYETRIDLSQLGGD

SEQ ID NO: 254 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKAKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 255 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKAKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 256 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKAKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIPRKTEWDPKKYGGFDSPIVAYSVLVVAKVEKGKSKKLKPVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKILSAYNKHRDKPIREQAENIINLFTFTNLGAPAAFKFFDTDIDRKRYTSTKEVLDATLIHQSITGLYETRIDLSQLGGD

SEQ ID NO: 257 - protein, 1382 aa, synthetic construct
MKKPYSIGLDIGTNSVGWAVVTDDYKVPAKKMKVLGNTDKSHIKKNLLGALLFDSGETAEGRRLKRTARRRYTRRRNRILYLQEIFAEEMNKIDESFFHRLDDSFLVPEDKRGSKYPIFATLEEEKEYHKKFPTIYHLRKHLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDLLRKQRTFDNGTIPYQVHLSEMKAIIHRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLIHDDGLSFKEIIQKAQVFGKTDDVKQVVQELPGSPAIKKGILQSIKIVDELVKVMGHAPESIVIEMARENQTTARGKKNSQQRYKRIEDSLKNLASGLDSNILKENPTDNVQLQNDRLFLYYLQNGKDMYTGEALDINQLSNYDIDHIIPQAFIKDDSLDNRVLTSSKDNRGKSDNVPSIEVVEKMKAFWQQLLDSKLISERKYNNLTKAERERGGLNELDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIPRKTEWDPKKYGGFDSPTVAYSVLVVAKVEKGKSKKLKSVKELVGITIMERSSFEKDPVDFLEAKGYKEVRKDLIIKLPKYSLFELENGRRRLLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFDTTIDRKRYTSTKEVLDATLIHQSITGLYETRIDLSQLGGD

SEQ ID NO: 258 - protein, 1380 aa, synthetic construct
MKKPYSIGLDIGTNSVGWAVITDDYKVPAKKMKVLGNTDKSHIKKNLLGALLFDSGNTAEDRRLKRTARRRYTRRRNRILYLQEIFAEEMNKIDESFFHRLDDSFLVPEDKRGSKYPIFATLEEEKEYHKQFPTIYHLRKKLAESNEKADLRLIYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKEILNNVKGADYFLEKIKREDFLRKQRTFDNGTIPYQVHLAEMRAILHRQGDYYPFLKDNKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIQFLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKQSNKTILDYLIDDDKINRNFMQLINDDGLSFKDIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGESLDINQLSNYDIDHIVPQAFIKDDSLDNRVLTSSKDNRGKSDNVPSLEVVQKRKAFWQQLLDSKLISERKFNNLTKAERGGLDERDKVGFIKRQLVETRQITKHVAQILDARFNTEVNEKNQKIRKVKIITLKSNLVSNFRKEFRLYKVREINDYHHAHDAYLNAVVAKAILKKYPKLEPEFVYGDYQKYDIKRYISKSKDPKDIEKATQKYFFYSNLLNFFKEEVHYADGTIVKRENVEYSKDTGEIAWNKEKDFATVRKVLSCPQVNIVKKTEVQTGGFSKESILPKRNSDKLIPRKTEWDPKKYGGFDSPTVAYSVLVVAKVEKGKSKKLKSVKELVGITIMERSSFEKDPVDFLEAKGYKEVRKDLIIKLPKYSLFELENGRRRLLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFDTTIDRKRYTSTKEVLDATLIHQSITGLYETRIDLSQLGGD

SEQ ID NO: 259 - protein, 1368 aa, synthetic construct
MDKKYSIGLDIGTNSVGWAVITDDYKVPAKKMKVLGNTDKRTIKKNLLGALLFDSGETAEATRLKRTARRRYTRRKNRLRYLQEIFSKEMSNVDANFFYRLEDSFLVPEDKQQERHPIFGNLVEEIEYHKEFPTIYHLRKQLADSKEKADLRLIYLALAHMIKYRGHFLFEGDLKSENTDVQRLFKDFVEVYDKTVEGSYLSENLTNVTDVLVEKISKSRRLENILHYFPNEKKNGLFGNFLALALGLQPNFKNNFDLAEEAKLQISKDTYEEELEVLLAQIGDNYAELFIATKELYDGILLAGILTVTDSSTKAPLSASMIERYENHQGDLAKLKAFIRRFCKETYDEVFSDEVKDGYAGYIEGKTSQEDFYVHLKKLLANLEGADYFLEKINREDLLRKQRTFDNGSIPYQIHLVEMRAILDKQAKFYPFLAKNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLMGLDKENKAFNASYGTYHDLRKILDKDFLDNSDNEKILEDIVLTLTLFEDREMIRKRLEKYKDIFTEKQRKQLERRHYTGWGRLSAKLIHGIRNKESRKTILDYLIDDGYSNRNFMQLINDDTLTFKEEIAKAQVVGETDSLKQFISELAGSPAIKKGILQTVKIVDELVKVMGHKPENIVIEMARENQTTQKGQKNSQERMKRIEEGIKELGSQILKEHPVENTQLQNEKLYLYYLQNGRDMYVDQELDINRLSDYDIDHIIPQAFIKDDSIDNRVLTSSKDNRGKSDNVPSEDVVKKMKNYWRQLLNAKLISQRKFDNLTKAERGGLSELDKVGFIKRQLVETRQITKHVAQILDSRMNTKYDENDKLIRDVKIITLKSKLVSDFRKDFQFYKVREINNYHHAHDAYLNAVVGTALIKKYPKLESEFVYGDYKVYDVQKMIAKSEQEIGKATAKFFFYSNIMNFFKTEITLANGEIRKRPMIETNEETGEIVWDKGRDFATVRKVLCMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHQHYLDEIIEQISEFSKRVILADANLDKVLSAYNKHRDKPIREQAENIIHLFTLTNLGAPAAFKYFDTTIDRKRYTSTKEVLDSTLIHQSITGLYETRIDLSQLGGD

SEQ ID NO: 260 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHQKDLALLKNLIKKNLTQEKYDEVFSDESKNGYAGYINGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIPRKKDWDPKKYGGFDSPTVAYSVLVVAKVEKGKSKKLKPVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSERVILADANLDKVLSAYNNHRDKPIREQAENIIHLFTLTNLGAPAAFKFFDTTIDRKRYTSTKEVLDATLIHQSITGLYETRIDLSKLGGD

SEQ ID NO: 261 - protein, 1370 aa, synthetic construct
MKKPYSIGLDIGTNSVGWAVVTDDYKVPAKKMKVLGNTNKESIKKNLIGALLFDAGNTAADRRLKRTARRRYTRRRNRILYLQEIFAEEMNKVDESFFHRLDDSFLVPEDKRGSKYPIFATLEEEKEYHKKFPTIYHLRKHLADSKEKADLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGMRDYQFLDSGQKKKIVSQLFEDKRKVTEKDIIHYLHTIDGYDGIELSGIEKQFNASLSTYHDLLKIIKDKAFLDDSENEAIIEEIIHTLTIFEDREMIKQRLAQYADIFDKSVLKKLARRHYTGWGKLSAKLINGIRDKQSNKTILDYLIDDGKINRNFMQLINDDSLSFKETIQKAQVVGDTDDVKQVVQELPGSPAIKKGILQSIKIVDELVKVMGHNPDNIVIEMARENQTTNRGRSQSQQRLKKLQDSLKELGSNILNEEKPSYIEDKVENSHLQNDQLFLYYIQNGKDMYTGEELDIDHLSDYDIDHIIPQAFIKDDSIDNRVLTSSAKNRGKSDDVPSLDIVRERKADWIRLYKSKLISKRKFDNLTKAERGGLTEADKAGFIKRQLVETRQITKHVAQILDSRFNTKRDENDKVIRDVKVITLKSNLVSQFRKDFELYKVREINDYHHAHDAYLNAVVGTALLKKYPKLAPEFVYGEYKKYDIRKFITSSKDKATAKYFFYSNLMNFFKRIIRYSNGKIVVRPVVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 262 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKIDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHQKDLALLKNLIKQNLTQEKYDEVFSDESKNGYAGYINGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKEIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIPRKKDWDPKKYGGFDSPTVAYSVLVVAKVEKGKSKKLKPVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKVLSAYNNHRDKPIREQAENIIHLFTLTNLGAPAAFKFFDTTIDRKRYTSTKEILDATLIHQSITGLYETRIDLSQLGGD

SEQ ID NO: 263 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDEAKNGYAGYIENGVKQDEFYKYLKSTLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMNFLGKEFDEFRIVDITGLDKENKAFNASLGTYHDLKKILDKSFLDDKVNETIIEDIIQTLTLFEDKDMIRQRLQKYSDIFTPQQLKKLERRHYTGWGRLSYKLINGIRDKQTGKTILDYLIDDGYANRNFMQLINDDSLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENSHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDNRFNTERDENDKVIRDVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEVKLANGEIRKRPLIETNEETGEIVWNKEKDFATVRKVLSCPQVNIVKKTEVQTGGFSKESILPKRNSDKLIPRKNGWDPKKYGGFDSPTVAYSVLVVAKVEKGKSKKLKTVKELVGITIMERSSFEKDPVDFLEAKGYKEVQKDLIIKLPKYSLFELENGRKRMLASAGELQKGNELALPSKYVNFLYLASHYEKLKGSPEDNEQKQLFVDQHKHYLDEIIEQISDFSKRVILADANLDKVLSAYNNHRDKPVREQAENIINLFTLTNLGAPAAFKFFDTTIDRKRYTSTKEILDATLIHQSITGLYETRIDLSQLGGD

SEQ ID NO: 264 - protein, 1374 aa, synthetic construct
MTKPYSIGLDIGTNSVGWAVITDSYKVPSKKMKVLGNTSKKYVKKNLLGVLLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIIDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKSKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIPRKKGWDPKKYGGFDSPTVAYSVLVVAKVEKGKSKKLKSVKELVGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSERVILADANLDKILSAYNKHRDKPIREQAENIIHLFTLTNLGAPAAFKFFDTTIDRKRYTSTKEVLDATLIHQSITGLYETRIDLSQLGGD

SEQ ID NO: 265 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKAKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIPRKKGWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFNTDIDRKRYTSTKEILDATLIHQSITGLYETRIDLSQLGGD

SEQ ID NO: 266 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKIDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNIADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHHKDLALLKNLIKQNLTQEKYDEVFSDESKNGYAGYINGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKEIIQKAQVVGKTNDVKQVVQELPGSPAIKKGILQSIKLVDELVKIMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFAIVRKVLSCPQVNIVKKTEVQTGGFSKESILPKRNSDKLIPRKKNWDPKKYGGFDSPTVAYSVLVVAKVEKGKSKKLKPVKELVGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSERVILADANLDKVLSAYNKHRDKPIREQAENIIHLFTLTNLGAPAAFKFFDTTIDRKRYTSTKEVLNATLIHQSITGLYETRIDLSKLGGD

SEQ ID NO: 267 - protein, 1370 aa, synthetic construct
MKKPYSIGLDIGTNSVGWAVVTDDYKVPAKKMKVLGNTNKESIKKNLIGALLFDAGNTAADRRLKRTARRRYTRRRNRILYLQEIFAEEMNKVDESFFHRLDDSFLVPEDKRGSKYPIFATLEEEKEYHKKFPTIYHLRKHLADSKEKADLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGMRDYQFLDSGQKKKIVSQLFEDKRKVTEKDIIHYLHTIDGYDGIELSGIEKQFNASLSTYHDLLKIIKDKAFLDDSENEAIIEEIIHTLTIFEDREMIKQRLAQYADIFDKSVLKKLARRHYTGWGKLSAKLINGIRDKQSNKTILDYLIDDGKINRNFMQLINDDSLSFKETIQKAQVVGDTDDVKQVVQELPGSPAIKKGILQSIKIVDELVKVMGHNPDNIVIEMARENQTTNRGRSQSQQRLKKLQDSLKELGSNILNEEKPSYIEDKVENSHLQNDQLFLYYIQNGKDMYTGEELDIDHLSDYDIDHIIPQAFIKDDSIDNRVLTSSAKNRGKSDDVPSLDIVRERKADWIRLYKSKLISKRKFDNLTKAERGGLTEADKAGFIKRQLVETRQITKHVAQILDSRFNTKRDENDKVIRDVKVITLKSNLVSQFRKDFELYKVREINDYHHAHDAYLNAVVGTALLKKYPKLAPEFVYGEYKKYDIRKFITSSKDKATAKYFFYSNLMNFFKRIIRYSNGKIVVRPVVEYSKDTGEIAWNKEKDFATVRKVLSCPQVNIVKKTEVQTGGFSKESILPKRNSDKLIPRKKGWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFNTDIDRKRYTSTKEILDATLIHQSITGLYETRIDLSQLGGD

SEQ ID NO: 268 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDSTLIHQSITGLYETRIDLSQLGGD

SEQ ID NO: 269 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYIESKVENSHLQNDRLFLYYIQNGKDMYTGEELDIDRLSDYDIDHIIPQAFIKDDSIDNRVLTSSAKNRGKSDDVPSLEVVRKRKTYWHQLLKSKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIPRKKNWDPKKYGGFDSPTVAYSVLVVAKVEKGKSKKLKPVKELVGITIMERSSFEKDPVDFLEAKGYKEVREDLIIKLPKYSLFELENGRKRLLASAGELQKGNELALPSKYVNFLYLASHYEKLKGSPEDNEQKQLFVEQHKHYLDEIVEQISEFSERVILADANLDKILSAYNKHRDKPIREQAENIIHLFTLTNLGAPAAFKFFDTTIDRKRYTSTKEVLDATLIHQSITGLYETRIDLSKLGGD

SEQ ID NO: 270 - protein, 1374 aa, synthetic construct
MKKPYSIGLDIGTNSVGWAVVDDDYKVPAKKMRVFGDTDRSHIKKNLLGTLLFDDGNTAESRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISLYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHEEDLAALKQFVKANLPEKYDEVFSDQSKDGYAGYIDGKTTQEAFYKYIKNLLSKLEGADYFLDKIEREDFLRKQRTFDNGSIPHQIHLQEMNAILRRQGEHYPFLKDNKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKTKRKVTEKDIINYLHKVDGYDGVEISGVEDRFNASLGTYHDLLKIIKDKSFLDDKKNEEIIEDIVLTLTLFEDRDMIRQRLQKYSDIFTPQQLKKLERRHYTGWGRLSYKLINGIRNKENNKSILDYLIDDGYANRNFMQLINDDTLPFKQIIQKSQVVGDIDDIKTVVHDLPGSPAIKKGILQSVKIVDELVKVMGHNPDNIVIEMARENQTTNRGRSQSQQRLKKLQESLKELGSNILNVEKPSYIEDKVENNHLQNDKLFLYYIQNGKDMYTGEELDIDHLSDYDIDHIIPQAFIKDDSIDNRVLTSSAKNRGKSDDVPSLDIVRGRKAEWIRLYKAKLISQRKFDNLTKAERGGLTENDKAGFIKRQLVETRQITKHVAQILDARFNTKRDENDKLIREVKVITLKSNLVSQFRKEFGFYKVREINDYHHAHDAYLNAVVGTAILKKYPKLTSEFVYGEYKKYDIRKFIKSDDHSEMGKATAKYFFYSNLLNFFKEEIKYANGKIVVRPVVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 271 - protein, 1380 aa, synthetic construct
MKKPYSIGLDIGTNSVGWAVVTDDYKVPSKKMKVLGNTDKSHIKKNLLGALLFESGETAEGRRLKRTARRRYTRRRNRILYLQEIFAEEMNKIDESFFHRLDDSFLVPEDKRGSKYPIFATLQEEKEYHKQFPTIYHLRKQLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDFLRKQRTFDNGTIPYQVHLTEMRAIIHRQGEHYPFLQENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDAKNEEILENIVHTLTIFEDREMIKQRLAQYDSLFDEKVIKALTRRHYTGWGKLSAKLINGIYDKQSKKTILDYLIDDDKINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEPLDINQLSSYDIDHIVPQAFIKDDSLDNRVLTSSKDNRGKSDNVPSLEVVQKRKAFWQQLLDSKLISEHKFNNLTKAERGGLDERDKVGFIKRQLVETRQITKHVAQILDARFNTEVNEKKQKIRSVKIITLKSNLVSNFRKEFRLYKVREINDYHHAHDAYLNAVVAKAILKKYPKLEPEFVYGDYQKYDIKRYISRSKDPKEVEKATQKYFFYSNLLNFFKEEVHYADGTIIKRENIEYSKDTGEIAWNKEKDFATVRKVLSCPQVNIVKKTEVQTGGFSKESILPKRNSDKLIPRKTEWDPKKYGGFDSPIVAYSVLVVAKVEKGKSKKLKPVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKILSAYNKHRDKPIREQAENIINLFTFTNLGAPAAFKFFDTDIDRKRYTSTKEVLDATLIHQSITGLYETRIDLSQLGGD

SEQ ID NO: 272 - protein, 1380 aa, synthetic construct
MKKSYSIGLDIGTNSVGWAVVDDDYKVPAKKMRVFGDTDRSHIKKNLLGTLLFDEGNTAESRRLKRTARRRYTRRRNRILYLQEIFATEMNKVDESFFHRLDDSFLVPEDKRGSKYPIFATLEEEKEYHKQFPTIYHLRKQLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSAKMVIRFKEHEEDLAALKHFIKANLPEKYDEVFSDDSKNGYAGYVGVDSKVRKRNGKLATEEEFYKYLKEILNNVKGADYFLEKIKREDFLRKQRTFDNGTIPYQVHLTEMRAILHRQGEYYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEELDINQLSNYDIDHIVPQAFIKDDSLDNRVLTSSKDNRGKSDNVPSLEVVQKRKAFWQQLLDSKLISERKFNNLTKAERGGLDERDKVGFIRRQLVETRQITKHVAQILDARFNTEVTENNQKIRKVKIITLKSNLVSNFRKEFGLYKVREINDYHHAHDAYLNAVVAKAILKKYPKLEPEFVYGDYQKYDIKRYISRSKDPKEVEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 273 - protein, 1368 aa, synthetic construct
MDKKYSIGLDIGTNSVGWAVITDDYKVPAKKMKVLGNTDKRTIKKNLLGALLFDSGETAEATRLKRTARRRYTRRKNRLRYLQEIFSKEMSNVDANFFYRLEDSFLVPEDKQQERHPIFGNLVEEIEYHKEFPTIYHLRKQLADSKEKADLRLIYLALAHMIKYRGHFLFEGDLKSENTDVQRLFKDFVEVYDKTVEGSYLSENLTNVTDVLVEKISKSRRLENILHYFPNEKKNGLFGNFLALALGLQPNFKNNFDLAEEAKLQISKDTYEEELEVLLAQIGDNYAELFIATKELYDGILLAGILTVTDSSTKAPLSASMIERYENHQGDLAKLKAFIRRFCKETYDEVFSDEVKDGYAGYIEGKTSQEDFYVHLKKLLANLEGADYFLEKINREDLLRKQRTFDNGSIPYQIHLVEMRAILDKQAKFYPFLAKNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLMGLDKENKAFNASYGTYHDLRKILDKDFLDNSDNEKILEDIVLTLTLFEDREMIRKRLEKYKDIFTEKQRKQLERRHYTGWGRLSAKLIHGIRNKESRKTILDYLIDDGYSNRNFMQLINDDTLTFKEEIAKAQVVGETDSLKQFISELAGSPAIKKGILQTVKIVDELVKVMGHKPENIVIEMARENQTTQKGQKNSQERMKRIEEGIKELGSQILKEHPVENTQLQNEKLYLYYLQNGRDMYVDQELDINRLSDYDIDHIIPQAFIKDDSIDNRVLTSSKDNRGKSDNVPSEDVVKKMKNYWRQLLNAKLISQRKFDNLTKAERGGLSELDKVGFIKRQLVETRQITKHVAQILDSRMNTKYDENDKLIRDVKIITLKSKLVSDFRKDFQFYKVREINNYHHAHDAYLNAVVGTALIKKYPKLESEFVYGDYKVYDVQKMIAKSEQEIGKATAKFFFYSNIMNFFKTEITLANGEIRKRPMIETNEETGEIVWDKGRDFATVRKVLCMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHQHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 274 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHHKDLALLKNLIKQNLTQEKYDEVFSDESKNGYAGYISGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 275 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKAKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 276 - protein, 1380 aa, synthetic construct
MKKPYSIGLDIGTNSVGWAVVTDDYKVPSKKMKVLGNTDKSHIKKNLLGALLFESGETAEGRRLKRTARRRYTRRRNRILYLQEIFAEEMNKIDESFFHRLDDSFLVPEDKRGSKYPIFATLQEEKEYHKQFPTIYHLRKQLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDFLRKQRTFDNGTIPYQVHLTEMRAIIHRQGEHYPFLQENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDAKNEEILENIVHTLTIFEDREMIKQRLAQYDSLFDEKVIKALTRRHYTGWGKLSAKLINGIYDKQSKKTILDYLIDDDKINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEPLDINQLSSYDIDHIVPQAFIKDDSLDNRVLTSSKDNRGKSDNVPSLEVVQKRKAFWQQLLDSKLISEHKFNNLTKAERGGLDERDKVGFIKRQLVETRQITKHVAQILDARFNTEVNEKKQKIRSVKIITLKSNLVSNFRKEFRLYKVREINDYHHAHDAYLNAVVAKAILKKYPKLEPEFVYGDYQKYDIKRYISRSKDPKEVEKATQKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 277 - protein, 1370 aa, synthetic construct
MKKPYSIGLDIGTNSVGWAVVTDDYKVPAKKMKVLGNTNKESIKKNLIGALLFDAGNTAADRRLKRTARRRYTRRRNRILYLQEIFAEEMNKVDESFFHRLDDSFLVPEDKRGSKYPIFATLEEEKEYHKKFPTIYHLRKHLADSKEKADLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGMRDYQFLDSGQKKKIVSQLFEDKRKVTEKDIIHYLHTIDGYDGIELSGIEKQFNASLSTYHDLLKIIKDKAFLDDSENEAIIEEIIHTLTIFEDREMIKQRLAQYADIFDKSVLKKLARRHYTGWGKLSAKLINGIRDKQSNKTILDYLIDDGKINRNFMQLINDDSLSFKETIQKAQVVGDTDDVKQVVQELPGSPAIKKGILQSIKIVDELVKVMGHNPDNIVIEMARENQTTNRGRSQSQQRLKKLQDSLKELGSNILNEEKPSYIEDKVENSHLQNDQLFLYYIQNGKDMYTGEELDIDHLSDYDIDHIIPQAFIKDDSIDNRVLTSSAKNRGKSDDVPSLDIVRERKADWIRLYKSKLISKRKFDNLTKAERGGLTEADKAGFIKRQLVETRQITKHVAQILDSRFNTKRDENDKVIRDVKVITLKSNLVSQFRKDFELYKVREINDYHHAHDAYLNAVVGTALLKKYPKLAPEFVYGEYKKYDIRKFITSSKDKATAKYFFYSNLMNFFKRIIRYSNGKIVVRPVVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 278 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATVRKVLSCPQVNIVKKTEVQTGGFSKESILPKRNSDKLIPRKKGWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFNTDIDRKRYTSTKEILDATLIHQSITGLYETRIDLSQLGGD

SEQ ID NO: 279 - protein, 1374 aa, synthetic construct
MKKPYSIGLDIGTNSVGWAVVDDDYKVPAKKMRVFGDTDRSHIKKNLLGTLLFDDGNTAESRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISLYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHEEDLAALKQFVKANLPEKYDEVFSDQSKDGYAGYIDGKTTQEAFYKYIKNLLSKLEGADYFLDKIEREDFLRKQRTFDNGSIPHQIHLQEMNAILRRQGEHYPFLKDNKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKTKRKVTEKDIINYLHKVDGYDGVEISGVEDRFNASLGTYHDLLKIIKDKSFLDDKKNEEIIEDIVLTLTLFEDRDMIRQRLQKYSDIFTPQQLKKLERRHYTGWGRLSYKLINGIRNKENNKSILDYLIDDGYANRNFMQLINDDTLPFKQIIQKSQVVGDIDDIKTVVHDLPGSPAIKKGILQSVKIVDELVKVMGHNPDNIVIEMARENQTTNRGRSQSQQRLKKLQESLKELGSNILNVEKPSYIEDKVENNHLQNDKLFLYYIQNGKDMYTGEELDIDHLSDYDIDHIIPQAFIKDDSIDNRVLTSSAKNRGKSDDVPSLDIVRGRKAEWIRLYKAKLISQRKFDNLTKAERGGLTENDKAGFIKRQLVETRQITKHVAQILDARFNTKRDENDKLIREVKVITLKSNLVSQFRKEFGFYKVREINDYHHAHDAYLNAVVGTAILKKYPKLTSEFVYGEYKKYDIRKFIKSDDHSEMGKATAKYFFYSNLLNFFKEEIKYANGKIVVRPVVEYSKDTGEIAWNKEKDFATVRKVLSCPQVNIVKKTEVQTGGFSKESILPKRNSDKLIPRKTEWDPKKYGGFDSPTVAYSVLVVAKVEKGKSKKLKSVKELVGITIMERSSFEKDPVDFLEAKGYKEVRKDLIIKLPKYSLFELENGRRRLLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFDTTIDRKRYTSTKEVLDATLIHQSITGLYETRIDLSQLGGD

SEQ ID NO: 280 - protein, 1380 aa, synthetic construct
MKKPYSIGLDIGTNSVGWAIVDDDYKVPAKKMRVFGDTDRSHIKKNLLGTLLFDSGETAESRRLKRTARRRYTRRRNRILYLQEIFAEEMNKVDDSFFHRLEDSFLVEEDKQGSKYPIFGTLEEEKEYHKQFPTIYHLRKQLAESNEKADLRLIYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDFLRKQRTFDNGSIPYQVHLTEMKAILQRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSIFDEKVIKALTRRHYTGWGKLSAKLINGICDKKTGKTILDYLIDDGKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEPLDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQKIREVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 281 - protein, 1382 aa, synthetic construct
MKKPYSIGLDIGTNSVGWAVVTDDYKVPAKKMKVLGNTDKSHIKKNLLGALLFDSGNTAEDRRLKRTARRRYTRRRNRILYLQEIFAEEMNKVDESFFHRLDDSFLVPEDKRGSKYPIFGTLEEEKEYHKQFPTIYHLRKQLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGSLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKEILNNLKGADYFLEKIKREDLLRKQRTFDNGTIPYQVHLTEMKAIIHRQGEHYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIVKRENIEYSKDTGEIAWNKEKDFATVRKVLSCPQVNIVKKTEVQTGGFSKESILPKRNSDKLIPRKTEWDPKKYGGFDSPIVAYSVLVVAKVEKGKSKKLKPVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKILSAYNKHRDKPIREQAENIINLFTFTNLGAPAAFKFFDTDIDRKRYTSTKEVLDATLIHQSITGLYETRIDLSQLGGD

SEQ ID NO: 282 - protein, 1375 aa, synthetic construct
MNKPYSIGLDIGTNSVGWSVVDDDYKVPAKKMRVFGDTDKGHIKKNLLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDESKNGYAGYIENGVKQDEFYKYLKSTLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMDFLGKEFDEFRIVDITGLDKENKAFNASLGTYHDLKKILDKSFLDDKENETIIEDIIQTLTLFEDRDMIRQRLQKYSDIFTPQQLKKLERRHYTGWGRLSYKLINGIRDKQTGKTILDYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENTHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIREVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIPRKKDWDPKKYGGFDSPTVAYSVLVVAKVEKGKSKKLKPVKELVGITIMERSSFEKNPIDFLEAKGYKEVQKDLIIKLPKYSLFELENGRRRMLASAGELQKGNELALPSKYVNFLYLASHYEKLKGSPEDNEQKQLFVDQHKHYLDEIIEQISEFSERVILADANLDKVLSAYNKHRDKPVREQAENIIHLFTLTNLGAPAAFKFFDTTIDRKRYTSTKEILDATLIHQSITGLYETRIDLSQLGGD

SEQ ID NO: 283 - protein, 1374 aa, synthetic construct
MKKPYSIGLDIGTNSVGWAVVDDDYKVPAKKMRVFGDTDRSHIKKNLLGTLLFDDGNTAESRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISLYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHEEDLAALKQFVKANLPEKYDEVFSDQSKDGYAGYIDGKTTQEAFYKYIKNLLSKLEGADYFLDKIEREDFLRKQRTFDNGSIPHQIHLQEMNAILRRQGEHYPFLKDNKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKTKRKVTEKDIINYLHKVDGYDGVEISGVEDRFNASLGTYHDLLKIIKDKSFLDDKKNEEIIEDIVLTLTLFEDRDMIRQRLQKYSDIFTPQQLKKLERRHYTGWGRLSYKLINGIRNKENNKSILDYLIDDGYANRNFMQLINDDTLPFKQIIQKSQVVGDIDDIKTVVHDLPGSPAIKKGILQSVKIVDELVKVMGHNPDNIVIEMARENQTTNRGRSQSQQRLKKLQESLKELGSNILNVEKPSYIEDKVENNHLQNDKLFLYYIQNGKDMYTGEELDIDHLSDYDIDHIIPQAFIKDDSIDNRVLTSSAKNRGKSDDVPSLDIVRGRKAEWIRLYKAKLISQRKFDNLTKAERGGLTENDKAGFIKRQLVETRQITKHVAQILDARFNTKRDENDKLIREVKVITLKSNLVSQFRKEFGFYKVREINDYHHAHDAYLNAVVGTAILKKYPKLTSEFVYGEYKKYDIRKFIKSDDHSEMGKATAKYFFYSNLLNFFKEEIKYANGKIVVRPVVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 284 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKKERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFSNRNFMQLINDDTLPFKQIIQKAQIVGDVDDIEQVVHDLPGSPAIKKGILQSIKIVDELVKVMGHNPDNIVIEMARENQTTNRGRSQSQQRLKKLQDSLKELGSNILNEEKPSYIESKVENSQLQNDRLFLYYIQNGKDMYTGDELDIDRLSDYDIDHIIPQAFIKDDSIDNRVLTSSAKNRGKSDDVPSLEVVRKRKTYWHQLLKSKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIPRKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSERVILADANLDKVLSAYNNHRDKPIREQAENIIHLFTLTNLGAPAAFKFFDTTIDRKRYTSTKEVLDATLIHQSITGLYETRIDLSKLGGD

SEQ ID NO: 285 - protein, 1380 aa, synthetic construct
MKKSYSIGLDIGTNSVGWAVVDDDYKVPAKKMRVFGDTDRSHIKKNLLGTLLFDEGNTAESRRLKRTARRRYTRRRNRILYLQEIFATEMNKVDESFFHRLDDSFLVPEDKRGSKYPIFATLEEEKEYHKQFPTIYHLRKQLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSAKMVIRFKEHEEDLAALKHFIKANLPEKYDEVFSDDSKNGYAGYVGVDSKVRKRNGKLATEEEFYKYLKEILNNVKGADYFLEKIKREDFLRKQRTFDNGTIPYQVHLTEMRAILHRQGEYYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEELDINQLSNYDIDHIVPQAFIKDDSLDNRVLTSSKDNRGKSDNVPSLEVVQKRKAFWQQLLDSKLISERKFNNLTKAERGGLDERDKVGFIRRQLVETRQITKHVAQILDARFNTEVTENNQKIRKVKIITLKSNLVSNFRKEFGLYKVREINDYHHAHDAYLNAVVAKAILKKYPKLEPEFVYGDYQKYDIKRYISRSKDPKEVEKATEKYFFYSNLLNFFKEEVHYADGTIVKRENIEYSKDTGEIAWNKEKDFATVRKVLSCPQVNIVKKTEVQTGGFSKESILPKRNSDKLIPRKTEWDPKKYGGFDSPIVAYSVLVVAKVEKGKSKKLKPVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKILSAYNKHRDKPIREQAENIINLFTFTNLGAPAAFKFFDTDIDRKRYTSTKEVLDATLIHQSITGLYETRIDLSQLGGD

SEQ ID NO: 286 - protein, 1368 aa, synthetic construct
MDKKYSIGLDIGTNSVGWAVITDDYKVPAKKMKVLGNTDKRTIKKNLLGALLFDSGETAEATRLKRTARRRYTRRKNRLRYLQEIFSKEMSNVDANFFYRLEDSFLVPEDKQQERHPIFGNLVEEIEYHKEFPTIYHLRKQLADSKEKADLRLIYLALAHMIKYRGHFLFEGDLKSENTDVQRLFKDFVEVYDKTVEGSYLSENLTNVTDVLVEKISKSRRLENILHYFPNEKKNGLFGNFLALALGLQPNFKNNFDLAEEAKLQISKDTYEEELEVLLAQIGDNYAELFIATKELYDGILLAGILTVTDSSTKAPLSASMIERYENHQGDLAKLKAFIRRFCKETYDEVFSDEVKDGYAGYIEGKTSQEDFYVHLKKLLANLEGADYFLEKINREDLLRKQRTFDNGSIPYQIHLVEMRAILDKQAKFYPFLAKNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLMGLDKENKAFNASYGTYHDLRKILDKDFLDNSDNEKILEDIVLTLTLFEDREMIRKRLEKYKDIFTEKQRKQLERRHYTGWGRLSAKLIHGIRNKESRKTILDYLIDDGYSNRNFMQLINDDTLTFKEEIAKAQVVGETDSLKQFISELAGSPAIKKGILQTVKIVDELVKVMGHKPENIVIEMARENQTTQKGQKNSQERMKRIEEGIKELGSQILKEHPVENTQLQNEKLYLYYLQNGRDMYVDQELDINRLSDYDIDHIIPQAFIKDDSIDNRVLTSSKDNRGKSDNVPSEDVVKKMKNYWRQLLNAKLISQRKFDNLTKAERGGLSELDKVGFIKRQLVETRQITKHVAQILDSRMNTKYDENDKLIRDVKIITLKSKLVSDFRKDFQFYKVREINNYHHAHDAYLNAVVGTALIKKYPKLESEFVYGDYKVYDVQKMIAKSEQEIGKATAKFFFYSNIMNFFKTEITLANGEIRKRPMIETNEETGEIVWDKGRDFATVRKVLCMPQVNIVKKTEVQTGGFSKESILPKRNSDKLIPRKKGWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFNTDIDRKRYTSTKEILDATLIHQSITGLYETRIDLSQLGGD

SEQ ID NO: 287 - protein, 1370 aa, synthetic construct
MKKPYSIGLDIGTNSVGWAVVTDDYKVPAKKMKVLGNTNKESIKKNLIGALLFDAGNTAADRRLKRTARRRYTRRRNRILYLQEIFAEEMNKVDESFFHRLDDSFLVPEDKRGSKYPIFATLEEEKEYHKKFPTIYHLRKHLADSKEKADLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGMRDYQFLDSGQKKKIVSQLFEDKRKVTEKDIIHYLHTIDGYDGIELSGIEKQFNASLSTYHDLLKIIKDKAFLDDSENEAIIEEIIHTLTIFEDREMIKQRLAQYADIFDKSVLKKLARRHYTGWGKLSAKLINGIRDKQSNKTILDYLIDDGKINRNFMQLINDDSLSFKETIQKAQVVGDTDDVKQVVQELPGSPAIKKGILQSIKIVDELVKVMGHNPDNIVIEMARENQTTNRGRSQSQQRLKKLQDSLKELGSNILNEEKPSYIEDKVENSHLQNDQLFLYYIQNGKDMYTGEELDIDHLSDYDIDHIIPQAFIKDDSIDNRVLTSSAKNRGKSDDVPSLDIVRERKADWIRLYKSKLISKRKFDNLTKAERGGLTEADKAGFIKRQLVETRQITKHVAQILDSRFNTKRDENDKVIRDVKVITLKSNLVSQFRKDFELYKVREINDYHHAHDAYLNAVVGTALLKKYPKLAPEFVYGEYKKYDIRKFITSSKDKATAKYFFYSNLMNFFKRIIRYSNGKIVVRPVVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 288 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHIIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTADDNSTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVRYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFSHFHGHKENKATAKKFFYSNIMALFKKDVEYSDDTGEMVWNKEKDFATVRKVLSCPQVNIVKKTEVQTGGFSKESILPKRNSDKLIPRKKDWDPKKYGGFDSPIVAYSVLVVAKVEKGKSKKLKPVKELVGITIMERNSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSERVILADANLDKVLSAYNNHRDKPIREQAENIIHLFTLTNLGAPAAFKFFDTTIDRKRYTSTKEVLDATLIHQSITGLYETRIDLSQLGGD

SEQ ID NO: 289 - protein, 1354 aa, synthetic construct
MKKSYSIGLDIGTNSVGWSVITDDYKVPAKKMKVLGNTDKKYIKKNLLGALLFDSGETAEATRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIEGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNTTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIVDKEESATAFIHRMTNNDLYLPEEKVLPKHSLIYEEFTVYNELTKVKYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYVEDKVENSHLQNDKLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFKHFHGHKENKATAKKFFYSNIMALFKKDVEYSDDTGEMVWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPIDFLEAKGYKEVRKDLIIKLPKYSLFELENGRKRMLASAGELQKGNELALPSKYVNFLYLASHYEKLKGSPEDNEQKQLFVEQHQHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 290 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKKERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFSNRNFMQLINDDTLPFKQIIQKAQIVGDVDDIEQVVHDLPGSPAIKKGILQSIKIVDELVKVMGHNPDNIVIEMARENQTTNRGRSQSQQRLKKLQDSLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVRKRKTYWHQLLKSKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKLVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIPRKKDWDPKKYGGFDSPTVAYSVLVVAKVEKGKSKKLKPVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKVLSAYNNHRDKPIREQAENIIHLFTLTNLGAPAAFKFFDTTIDRKRYTSTKEVLDATLIHQSITGLYETRIDLSKLGGD

SEQ ID NO: 291 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTATDPSTKAPLSASMIERYENHQKDLSTLKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKIIKALTRRHYTGWGKLSAKLINGICDKQTGKTILDYLIDDGFSNRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKSKLISQRKFDNLTKAERGGLTEKDKAGFIKRQLVETRQITKHVAQILDSRFNTKRDENDKVIRDVKVITLKSNLVSQFRKEFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVKKVLSCPQVNIVKKTEVQTGGFSKESILPKRNSDKLIPRKKDWDPKKYGGFDSPTVAYSVLVVAKVEKGKSKKLKPVKELVGITIMERSSFEKDPIDFLEAKGYKEVRKDLIIKLPKYSLFELENGRKRLLASAGELQKGNELALPSKYVNFLYLASHYEKLKGSPEDNEQKQLFVEQHKHYLDEIVEQISEFSERVILADANLDKVLSAYNKHRDKPIREQAENIIHLFTLTNLGAPAAFKFFDTTIDRKRYTSTKEVLDATLIHQSITGLYETRIDLSKLGGD

SEQ ID NO: 292 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFANRNFMQLINDDTLPFKQIIQKAQIVGDVDDIEQVVHNLPGSPAIKKGILQSIKIVDELVKVMGHNPDNIVIEMARENQTTNRGRSQSQQRLKKLQESLKELGSNILNEEKPSYVESKVENSQLQNDRLFLYYIQNGKDMYTGEELDIDRLSDYDIDHIIPQAFIKDDSIDNRVLTSSAKNRGKSDDVPSLEVVKKRKTYWHQLLKAKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDSTLIHQSITGLYETRIDLSQLGGD

SEQ ID NO: 293 - protein, 1380 aa, synthetic construct
MKKSYSIGLDIGTNSVGWAVVDDDYKVPAKKMRVFGDTDRSHIKKNLLGTLLFDEGNTAESRRLKRTARRRYTRRRNRILYLQEIFATEMNKVDESFFHRLDDSFLVPEDKRGSKYPIFATLEEEKEYHKQFPTIYHLRKQLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSAKMVIRFKEHEEDLAALKHFIKANLPEKYDEVFSDDSKNGYAGYVGVDSKVRKRNGKLATEEEFYKYLKEILNNVKGADYFLEKIKREDFLRKQRTFDNGTIPYQVHLTEMRAILHRQGEYYPFLKENKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEELDINQLSNYDIDHIVPQAFIKDDSLDNRVLTSSKDNRGKSDNVPSLEVVQKRKAFWQQLLDSKLISERKFNNLTKAERGGLDERDKVGFIRRQLVETRQITKHVAQILDARFNTEVTENNQKIRKVKIITLKSNLVSNFRKEFGLYKVREINDYHHAHDAYLNAVVAKAILKKYPKLEPEFVYGDYQKYDIKRYISRSKDPKEVEKATEKYFFYSNLLNFFKEEVHYADGTIVKRENIEYSKDTGEIAWNKEKDFATVRKVLSCPQVNIVKKTEVQTGGFSKESILPKRNSDKLIPRKTEWDPKKYGGFDSPTVAYSVLVVAKVEKGKSKKLKSVKELVGITIMERSSFEKDPVDFLEAKGYKEVRKDLIIKLPKYSLFELENGRRRLLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFDTTIDRKRYTSTKEVLDATLIHQSITGLYETRIDLSQLGGD

SEQ ID NO: 294 - protein, 1370 aa, synthetic construct
MKKPYSIGLDIGTNSVGWAVVTDDYKVPAKKMKVLGNTNKESIKKNLIGALLFDAGNTAADRRLKRTARRRYTRRRNRILYLQEIFAEEMNKVDESFFHRLDDSFLVPEDKRGSKYPIFATLEEEKEYHKKFPTIYHLRKHLADSKEKADLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIQNNLQEKYDEVFSDQSKDGYAGYIDGKTTQEAFYKYIKNLLSKLEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGMRDYQFLDSGQKKKIVSQLFEDKRKVTEKDIIHYLHTIDGYDGIELSGIEKQFNASLSTYHDLLKIIKDKAFLDDSENEAIIEEIIHTLTIFEDREMIKQRLAQYADIFDKSVLKKLARRHYTGWGKLSAKLINGIRDKQSNKTILDYLIDDGKINRNFMQLINDDSLSFKETIQKAQVVGDTDDVKQVVQELPGSPAIKKGILQSIKIVDELVKVMGHNPDNIVIEMARENQTTNRGRSQSQQRLKKLQDSLKELGSNILNEEKPSYIEDKVENSHLQNDQLFLYYIQNGKDMYTGEELDIDHLSDYDIDHIIPQAFIKDDSIDNRVLTSSAKNRGKSDDVPSLDIVRERKADWIRLYKSKLISKRKFDNLTKAERGGLTEADKAGFIKRQLVETRQITKHVAQILDSRFNTKRDENDKVIRDVKVITLKSNLVSQFRKDFELYKVREINDYHHAHDAYLNAVVGTALLKKYPKLAPEFVYGEYKKYDIRKFITSSKDKATAKYFFYSNLMNFFKRIIRYSNGKIVVRPVVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 295 - protein, 1354 aa, synthetic construct
MKKSYSIGLDIGTNSVGWSVITDDYKVPAKKMKVLGNTDKKYIKKNLLGALLFDSGETAEGTRLKRTARRRYTRRKNRLRYLQEIFAKEMAKVDESFFQRLEESFLTDDDKNFDSHPIFGNKAEEDAYHDEFPTIYHLRQYLADSPQKADLRLVYLALAHMIKFRGHFLIQGQLNAENTDVQTLFNDFVEVYDKTVEESHLSEITVDALSILTEKVSKSRRLENLVKCYPTEKKNTLFGNLIALSLGLQPNFKTNFKLSEDAKLQFSKDTYEEDLEELLGKIGDEYADLFASAKNLYDAILLSGILTVDDNSTKAPLSASMVKRYAEHHEDLEKLKEFVKANKPELYHDIFKDETKNGYAGYIENGVKQDEFYKYLKNTLSKIAGSDYFLDKIEREDFLRKQRTFDNGSIPHQIHLQEMHAILRRQGEYYPFLKENQAKIEKILTFRIPYYVGPLARKNSRFAWAEYHSDEKITPWNFEEIIDKEESATAFIHRMTNNDLYLPEEKVLPKHSLIYEEFTVYNELTKVRYVTDQGKAYYFDANMKQEIFDGVFKEHRKVTKDKLMNFLEKEFDEFRIVDLTGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKTILDYLIDDGYANRNFMQLINDDTLPFKQIIQEAQIIGDIDDIETVVHDLPGSPAIKKGILQSVKIVDELVKVMGHNPDNIVIEMARENQTTNRGRSQSQQRLKKLQESLKELGSNILNEEKPSYIEDKVENSHLQNDRLFLYYIQNGKDMYTGEELDIDHLSDYDIDHIIPQAFIKDNSIDNRVLTSSAKNRGKSDDVPSLDIVHDRKADWIRLYKSGLISKRKFDNLTKAEHGGLTEDDKAGFIKRQLVETRQITKHVAQILDSRFNTERDENDKVIRDVKVITLKSNLVSQFRKDFELHKVREINDYHHAHDAYLNAVIGNALLVKYPQLEPEFVYGKFSHFHGHKENKATAKKFFYSNIMALFKKDVEYSDDTGEMVWNKEKDFATVRKVLSCPQVNVVKKTEVQTGGFSKESILPKRNSDKLIPRKNDWDPKKYGGFDSPIVAYSVLVIAKVEKGKSKKLKPVKELVGITIMERSSFEKDPIDFLEAKGYKDVRKDLIIKLPKYSLFELENGRKRMLASAGELQKGNELALPSKYVNFLYLASHYEKLKGSPEDNEQKQLFVEQHKHYLDEIIEQISEFSERVILADSNLDKVLSAYNNHRDKPIREQAENIIHLFTLTNLGAPAAFKFFDTTIDRKRYTSTKEILDATLIHQSITGLYETRIDLSQLGGD

SEQ ID NO: 296 - protein, 1374 aa, synthetic construct
MTKPYSIGLDIGTNSVGWAVITDSYKVPSKKMKVLGNTSKKYVKKNLLGALLFESGITAEGRRLKRTARRRYTRRRNRILYLQEIFSTEMAKIDESFFQRLDDSFLVPDDKRDSKYPIFGNLVKEKTYHDEFPTIYHLRKYLADSSKKADLRLVYLALAHMIKYRGHFLIEGDFNSRNNDIKKNFQNFLDSYNAIFESDLSLENSKQLEEIVKDKISKSAKKERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLSALKQFIRSNLSEKYDEVFSDQSKDGYAGYINGKTTQEAFYKYIKNLLSKFEGADYFLDKIEREDFLRKQRTFDNGSIPHQIHLQEMNAIIRRQGEHYPFLKENKEKIEKILTFRIPYYVGPLARGNRDFAWLTRNSDQAIRPWNFEEVVDKASSAEAFINKMTNFDLYLPEEKVLPKHSLLYETFAVYNELTKVKFIAEGLRDYQFLDSGQKKQIVNQLFKEKRKVTEKDIIQFLHNVDGYDGIELKGIEKQFNASLATYHDLLKIIKDKEFMDDPKNEEILENIIHTLTIFEDREMIKQRLAQYDSLFDEKVIKALTRRHYTGWGKLSAKLINGICDKQTGKTILDYLIDDGFSNRNFMQLINDDTLPFKQIIQKAQIVGDVDDIEQVVHDLPGSPAIKKGILQSIKIVDELVKVMGHNPDNIVIEMARENQTTNRGRSQSQQRLKKLQDSLKELGSNILNEEKPSYIESKVENSQLQNDRLFLYYIQNGKDMYTGDELDIDRLSDYDIDHIIPQAFIKDDSIDNRVLTSSAKNRGKSDDVPSLEVVKKRKTFWHQLLKSKLISQRKFDNLTKAERGGLTEKDKAGFIKRQLVETRQITKHVAQILDSRFNTKRDENDKVIRDVKVITLKSNLVSQFRKDFGFYKVREINDYHHAHDAYLNAVVGTALLKKYPKLAPEFVYGEYKKYDVRKIVRSKDESSLGKATAKMFFYSNLMNFFKKEVRLSDGTVIVRPVIEYSKDTGEIAWNKEKDFATVRKVLSCPQVNIVKKTEVQTGGFSKESILPKRNSDKLIPRKKNWDPKKYGGFDSPTVAYSVLVVAKVEKGKSKKLKSVKELVGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSERVILADANLDKVLSAYNKHRDKPIREQAENIIHLFTLTNLGAPAAFKFFDTTIDRKRYTSTKEVLDATLIHQSITGLYETRIDLSKLGGD

SEQ ID NO: 297 - protein, 1375 aa, synthetic construct
MNKPYSIGLDIGTNSVGWSVVDDDYKVPAKKMRVFGDTDKGHIKKNMLGTLLFDSGETAESRRLKRTARRRYTRRRNRILYLQEIFAKEMAKVDESFFHRLDESFLTDDDKTFDSHPIFGNKAEEDAYHQQFPTIYHLRKHLADSTEKADLRLVYLALAHMIKFRGHFLIEGELNAENTDVQKLFADFVGVYDRTFDDSHLSEITVDASSILTEKISKSRRLEKLIKHYPTEKKNTLFGNLVALALGLQPNFKTNFKLSEDAKLQFSKDTYEEDLEELLGKIGDDYADLFTSAKNLYDAILLSGILTVDDESTKAPLSASMIKRYAEHHEDLEKLKEFVKANKPELYHDIFKDETKNGYAGYIENGVKQDEFYKYLKSTLSKQDGSQYFLDKIEREDFLRKQRTFDNGSIPHQLHLKEMRSILHRQGEYYPFLKENQAKIEKILTFRIPYYVGPLARKDSRFAWAEYHSDEPITPWNFDEVVDKEKSAEKFITRMTLNDLYLPEEKVLPKHSHVYETYTVYNELTKVKYVNEQGEAKFFDANMKQEIFDHVFKENRKVTKDKLMNFLGKEFDEFRIVDITGLDKENKAFNASLGTYHDLKKILDKSFLDDKENETIIEDIIQTLTLFEDKDMIRQRLQKYSDIFTPQQLKKLERRHYTGWGRLSYKLINGIRDKQTGKTILGYLIDDGYANRNFMQLINDDTLPFKEIIQKAQIIGDIDDIKAVVHDLPGSPAIKKGILQSVKIVDELVKVMGHNPDNIVIEMARENQTTNRGRTQSQQRLKKLQESLKELGSNILNEKKPSYVEDKVENSHLQNDRLFLYYIQNGKDMYTGDELDIDHLSDYDIDHIIPQAFIKDDSIDNRVLTSSAKNRGKSDDVPSIEIVRDRKADWMRLRKAGLISKRKFDNLTKAERGGLTEADKAGFIKRQLVETRQITKHVAQILDSRFNTERDENDKVIRDVKVITLKSNLVSQFRKDFQFYKVREINDYHHAHDAYLNAVVGTALIKKYPKLESEFVYGDYKVYDVRKMIAKSEQEIGKATAKRFFYSNIMNFFKTEIKLANGEIRKRPLIETNEETGEIVWNKEKDFATVRKVLSCPQVNIVKKTEVQTGGFSKESILPKRNSDKLIPRKKNWDPKKYGGFDSPTVAYSVLVVAKVEKGKSKKLKSVKELVGITIMERSSFEKNPVDFLEAKGYKEVRKDLIIKLPKYSLFELENGRKRLLASAGELQKGNELALPSKYVNFLYLASHYEKLKGSPEDNEQKQLFVEQHKYYLDELIDQISDFSKRVILADANLDKLLSAYNNHRDKPIREQAENIIHLFTLTNLGAPAAFKFFDTTIDRKRYTSTKEILDATLIHQSVTGLYETRIDLSQLGGD

SEQ ID NO: 298 - protein, 1374 aa, synthetic construct
MKKPYSIGLDIGTNSVGWAVVDDDYKVPAKKMRVFGDTDRSHIKKNLLGTLLFDDGNTAESRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISLYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHEEDLAALKQFVKANLPEKYDEVFSDQSKDGYAGYIDGKTTQEAFYKYIKNLLSKLEGADYFLDKIEREDFLRKQRTFDNGSIPHQIHLQEMNAILRRQGEHYPFLKDNKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKTKRKVTEKDIINYLHKVDGYDGVEISGVEDRFNASLGTYHDLLKIIKDKSFLDDKKNEEIIEDIVLTLTLFEDRDMIRQRLQKYSDIFTPQQLKKLERRHYTGWGRLSYKLINGIRNKENNKSILDYLIDDGYANRNFMQLINDDTLPFKQIIQKSQVVGDIDDIKTVVHDLPGSPAIKKGILQSVKIVDELVKVMGHNPDNIVIEMARENQTTNRGRSQSQQRLKKLQESLKELGSNILNVEKPSYIEDKVENNHLQNDKLFLYYIQNGKDMYTGEELDIDHLSDYDIDHIIPQAFIKDDSIDNRVLTSSAKNRGKSDDVPSLDIVRGRKAEWIRLYKAKLISQRKFDNLTKAERGGLTENDKAGFIKRQLVETRQITKHVAQILDARFNTKRDENDKLIREVKVITLKSNLVSQFRKEFGFYKVREINDYHHAHDAYLNAVVGTAILKKYPKLTSEFVYGEYKKYDIRKFIKSDDHSEMGKATAKYFFYSNLLNFFKEEIKYANGKIVVRPVVEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 299 - protein, 1374 aa, synthetic construct
MKKPYSIGLDIGTNSVGWAVVDDDYKVPAKKMRVFGDTDRSHIKKNLLGTLLFDDGNTAESRRLKRTARRRYTRRRNRILYLQEIFAEEMNKVDESFFHRLDDSFLVPEDKRGSKYPIFATLEEEKEYHKKFPTIYHLRKHLADSKEKTDLRLIYLALAHMIKYRGHFLYEESFDIKNNDIQKIFNEFISLYDNTFEGSSLSGQNAQVEAIFTDKISKSAKRERVLKLFPDEKSTGLFSEFLKLIVGNQADFKKHFDLEEKAPLQFSKDTYDEDLENLLGQIGDDFADLFLVAKKLYDAILLSGILTVTDPSTKAPLSASMIERYENHEEDLAALKQFVKANLPEKYDEVFSDQSKDGYAGYIDGKTTQEAFYKYIKNLLSKLEGADYFLDKIEREDFLRKQRTFDNGSIPHQIHLQEMNAILRRQGEHYPFLKDNKEKIEKILTFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKTKRKVTEKDIINYLHKVDGYDGVEISGVEDRFNASLGTYHDLLKIIKDKSFLDDKKNEEIIEDIVLTLTLFEDRDMIRQRLQKYSDIFTPQQLKKLERRHYTGWGRLSYKLINGIRNKENNKSILDYLIDDGYANRNFMQLINDDTLPFKQIIQKSQVVGDIDDIKTVVHDLPGSPAIKKGILQSVKIVDELVKVMGHNPDNIVIEMARENQTTNRGRSQSQQRLKKLQESLKELGSNILNVEKPSYIEDKVENNHLQNDKLFLYYIQNGKDMYTGEELDIDHLSDYDIDHIIPQAFIKDDSIDNRVLTSSAKNRGKSDDVPSLDIVRGRKAEWIRLYKAKLISQRKFDNLTKAERGGLTENDKAGFIKRQLVETRQITKHVAQILDARFNTKRDENDKLIREVKVITLKSNLVSQFRKEFGFYKVREINDYHHAHDAYLNAVVGTAILKKYPKLTSEFVYGEYKKYDIRKFIKSDDHSEMGKATAKYFFYSNLLNFFKEEIKYANGKIVVRPVVEYSKDTGEIAWNKEKDFATVRKVLSCPQVNIVKKTEVQTGGFSKESILPKRNSDKLIPRKKGWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFNTDIDRKRYTSTKEILDATLIHQSITGLYETRIDLSQLGGD

SEQ ID NO: 300 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHHKDLALLKNLIKQNLTQEKYDEVFSDESKNGYAGYISGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEEQTGGFSKESILPKRNSDKLIPRKTEWDPKKYGGFDSPIVAYSVLVVAKVEKGKSKKLKSVKELVGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKVLSAYNKHRDKPIREQAENIIHLFTLTNLGAPAAFKFFNTDIDRKRYTSTKEVLDATLIHQSITGLYETRIDLSQLGGD

SEQ ID NO: 301 - protein, 1373 aa, synthetic construct
MKKPYSIGLDIGTNSVGWAVVTDDYKVPAKKMKVLGDTDKSHIKKNLLGTLLFESGETAEGRRLKRTARRRYTRRRNRILYLQEIFAEEMNKVDDSFFQRLDESFLKDDDKNFDSHPIFGNKAEEDAYHQKFPTIYHLRQYLADSPEKADLRLVYLALAHIIKYRGHFLFEGDLKSENKDVQHLFNDFVEMFDKTVEGSYLSENLPNVADVLVEKVSKSRRLENVLHYFPNEKKNGLFGNFIALALGLQPNFKTNFKLSEDAKLQFSKDTYDEDLEELLGKIGDDYADLFVAAKNLYDAILLSGILTVTDPTTKAPLSASMIDRYEKHHKDLALLKNLIKQNLTQEKYDEVFSDESKNGYAGYISGKVKQEEFYKYLKNTLSKIEGSDYFLDKIEREDFLRKQRTFDNGSIPHQIHLQEMNAIIRRQGEHYPFLKENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLINDDGLSFKDIIQKAQVVGKTNDVKQVVQELPGSPAIKKGILQSIKLVDELVKVMGHAPESIVIEMARENQTTARGKKNSQQRYKRIEDALKNLAPGLDSNILKENPTDNIQLQNDRLFLYYLQNGKDMYTGEALDINQLSNYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVDENNQRIRKVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIIKRENIEYSNDTGEIAWNKEKDFATVRKVLSCPQVNIVKKTEVQTGGFSKESILPKRNSDKLIPRKKGWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIVEQISEFSERVILADANLDKVLSAYNKNRDRPIREQAENIIHLFTLTNLGAPAAFKFFNTDIDRKRYTSTKEILDATLIHQSITGLYETRIDLSQLGGD

SEQ ID NO: 302 - protein, 1380 aa, synthetic construct
MKKSYSIGLDIGTNSVGWAVVDDDYKVPAKKMRVFGDTDRSHIKKNLLGTLLFDEGNTAESRRLKRTARRRYTRRRNRILYLQEIFAEEMNKVDESFFHRLDDSFLVPEDKRGSKYPIFATLQEEKEYHKQFPTIYHLRKQLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGSLLALIGENFIELFSAVKNLSDGILLAGIVSDESPHAPLSTKMVIRFKEHEEDLAALKHFIKTNLPEKYDEVFSDDSKNGYAGYVGVDSKVRKRNGKLATEEEFYKYLKEILNNVKGADYFLEKIKREDLLRKQRTFDNGTIPYQVHLTEMKAIIHRQGEHYPFLQENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKKTGKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGEALDINQLSSYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVNEKGQKIRKVKIITLKSNLVSNFRKEFGLYKVREINDYHHAHDAYLNAVVAKAILKKYPKLEPEFVYGDYQKYDIKRYISRSKDPKEIEKATEKYFFYSNLLNFFKEEVHYADGTIVKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 303 - protein, 1382 aa, synthetic construct
MKKPYSIGLDIGTNSVGWAVVTDDYKVPAKKMKVLGNTDKSHIKKNLLGALLFDSGETAEGRRLKRTARRRYTRRRNRILYLQEIFAEEMNKIDESFFHRLDDSFLVPEDKRGSKYPIFATLEEEKEYHKKFPTIYHLRKHLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDESPHAPLSTKMVIRFKEHEEDLAALKHFIKANLPEKYDEVFSDDSKNGYAGYVGVDSKVRKRNGKLATEEEFYKYLKDILNNVKGADYFLEKIKREDLLRKQRTFDNGTIPYQVHLSEMKAIIHRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIYDKQSKKTILDYLIDDGEINRNFMQLIHDDGLSFKEIIQKAQVFGKTDDVKQVVQELPGSPAIKKGILQSIKIVDELVKVMGHAPESIVIEMARENQTTARGKKNSQQRYKRIEDSLKNLASGLDSNILKENPTDNVQLQNDRLFLYYLQNGKDMYTGEALDINQLSNYDIDHIIPQAFIKDDSLDNRVLTSSKDNRGKSDNVPSIEVVEKMKAFWQQLLDSKLISERKYNNLTKAERERGGLNELDKVGFIKRQLVETRQITKHVAQILDARFNTEVNENNQKIRKVKIITLKSNLVSNFRKEFGLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 304 - protein, 1380 aa, synthetic construct
MKKPYSIGLDIGTNSVGWAVVTDDYKVPAKKMKVLGNTDKSHIKKNLLGTLLFDSGETAEGRRLKRTARRRYTRRRNRILYLQEIFAEEMNKVDESFFHRLDDSFLVPEDKRGSKYPIFGTLEEEKEYHKQFPTIYHLRKQLAESNEKADLRLVYLALAHMIKYRGHFLIDDPKFKVQNNDIQGLFEKFVEEYDNVQETSLSKIKLNVTEILTANIPKSEKQEQLLKNYPSEKKNTLFGNLIGLALGLTPNFKTNFSLENDAKLQISSESYEEDLGNLLALIGENFIELFSAVKNLSDGILLAGIVSDETPHAPLSTKMVIRFKEHEEDLAALKHFIKANLPEKYDEVFSDDSKNGYAGYVGVDSKVRKRNGKLATEEEFYKYLKEILNNVKGADYFLEKIKREDLLRKQRTFDNGTIPYQVHLSEMKAIIHRQGEHYPFLQENKEKIEKILTFRIPYYVGPLARGNRDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGIRDKQSNKTILDYLIDDDKINRNFMQLINDDGLSFKEIIQKAQVVGKTDDVKQVVQELPGSPAIKKGILQSIKIVDELVKVMGHAPESIVIEMARENQTTARGKKNSQQRYKRIEDALKNLAPGLDSNILKENPTDNIQLQNDRLFLYYLQNGKDMYTGNPLDINQLSSYDIDHIVPQAFIKDDSLDNRVLTSSKDNRGKSDNVPSIEVVQKRKAFWQQLLDSKLISERKFNNLTKAERGGLDERDKVGFIKRQLVETRQITKHVAQILDARFNTEVNEKNQKIRSVKIITLKSNLVSNFRKEFRLYKVREINDYHHAHDAYLNAVVAKAILKKYPKLEPEFVYGDYQKYDIKRYISRSKDPKDIEKATEKYFFYSNLLNFFKEEVHYADGTIIKRENIEYSKDTGEIAWNKEKDFATVRKVLSCPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 305 - DNA, 102 bp, synthetic construct
  source 1..102: mol_type = other DNA
gttttagagctgtgttgaaaaacacagcaaagttaaaataaggctttgtccgtatccaacttgaaaaagtgcgcaccgattcggtgcttttttgttttacta

SEQ ID NO: 306 - DNA, 100 bp, synthetic construct
  source 1..100: mol_type = other DNA
gttttagagctgtgttgaaaaacacagcaagttaaaataaggctttgtccgtatccaacttgaaaaagtgagcaccgattcggtgctttttttgtgccca

SEQ ID NO: 307 - DNA, 100 bp, synthetic construct
  source 1..100: mol_type = other DNA
gttttagagctgtgttgaaaaacacagcaagttaaaataaggctttgtccgtacacaacttgaaaaagtgagcaccgattcggtgctttttttgtgccta

SEQ ID NO: 308 - DNA, 100 bp, synthetic construct
  source 1..100: mol_type = other DNA
gttttagagctgtgttgaaaaacacagcaagttaaaataaggctttgtccgtacacaacttgaaaaagtgagcaccgattcggtgctttttttgtgccca

SEQ ID NO: 309 - DNA, 100 bp, synthetic construct
  source 1..100: mol_type = other DNA
gttttagagctgtgttgaaaaacacagcaagttaaaataaggctttgtccgtacacaacttgaaaaagtgagcaccgattcggtgcttttttgttttcta

SEQ ID NO: 310 - DNA, 100 bp, synthetic construct
  source 1..100: mol_type = other DNA
gttttagagctgtgttgaaaaacacagcaagttaaaataaggctttgtccgtacacaacttgaaaaagtgcgcaccgattcggtgctttttttgtgcctt

SEQ ID NO: 311 - DNA, 101 bp, synthetic construct
  source 1..101: mol_type = other DNA
gttttagagctgtgttgaaaaacacagcaagttaaaataaggctttgtccgtacacaacttgaaaaagtgagcaccgattcggtgcttttttgtatacaaa

SEQ ID NO: 312 - DNA, 102 bp, synthetic construct
  source 1..102: mol_type = other DNA
gttttagagctgtgttgaaaaacacagcaaagttaaaataaggctttgtccgtacacaacttgaaaaagtgcgcaccgattcggtgcttttttgttttacta

SEQ ID NO: 313 - DNA, 99 bp, synthetic construct
  source 1..99: mol_type = other DNA
gttttagagctgtgttgaaaaacacagcaagttaaaataaggctttgtccgtatccaacttgaaaaagtgcgcaccgattcggtgctttttttgtgccc

SEQ ID NO: 314 - DNA, 101 bp, synthetic construct
  source 1..101: mol_type = other DNA
gttttagagctgtgttgaaaaacacagcaagttaaaataaggcttagtccgtattcaacttgaaaaagtgcgcaccgattcggtgcttttttgttttacta

SEQ ID NO: 315 - DNA, 99 bp, synthetic construct
  source 1..99: mol_type = other DNA
gttttagagctgtgttgaaaaacacagcaagttaaaataaggcttagtccgtacacaacttgaaaaagtgcgcaccgattcggtgctttttttgtgccc

SEQ ID NO: 316 - DNA, 101 bp, synthetic construct
  source 1..101: mol_type = other DNA
gttttagagctgtgttgaaaaacacagcaagttaaaataaggctttgtccgtacacaacttgaaaaagtgagcaccgattcggtgcttttttgttttacta

SEQ ID NO: 317 - DNA, 104 bp, synthetic construct
  source 1..104: mol_type = other DNA
gttttagagctgtgttgaaaaacacagcaagttaaaataaggctttgtccgtacacaacttgaaaaagtgagcaccgattcggtgcttttttgttttacacaac

SEQ ID NO: 318 - DNA, 100 bp, synthetic construct
  source 1..100: mol_type = other DNA
gttttagagctgtgttgaaaaacacagcaagttaaaataaggctttgtccgtacacaacttgaaaaagtgagcaccgattcggtgcttttttattttata

SEQ ID NO: 319 - DNA, 99 bp, synthetic construct
  source 1..99: mol_type = other DNA
gttttagagctgtgttgaaaaacacagcaagttaaaataaggctttgtccgtacacaacttgaaaaagtgcgcaccgattcggtgctttttttgtgccc

SEQ ID NO: 320 - DNA, 101 bp, synthetic construct
  source 1..101: mol_type = other DNA
gttttagagctgtgttgaaaaacacagcaagttaaaataaggctttgtccgtacacaacttgaaaaagtgagcaccgattcggtgctttttttgtgcccta

SEQ ID NO: 321 - DNA, 99 bp, synthetic construct
  source 1..99: mol_type = other DNA
gttttagagctgtgctgaaaaacacagcgagttaaaataaggctttgtccgtacacaacttgaaaaagtggcaccgattcggtgcttttttattttatt

SEQ ID NO: 322 - DNA, 99 bp, synthetic construct
  source 1..99: mol_type = other DNA
gttttagagctgtgctgaaaaacacagcaagttaaaataaggctttgtccgtacacaacttgtaaaagtgagcaccgattcggtgcttttttgttgctt

SEQ ID NO: 323 - DNA, 100 bp, synthetic construct
  source 1..100: mol_type = other DNA
gttttagagctgtgttgaaaaacacagcaagttaaaataaggctttgtccgtacacaacttgaaaaagtgagcaccgattcggtgctttttttgtataca

SEQ ID NO: 324 - DNA, 99 bp, synthetic construct
  source 1..99: mol_type = other DNA
gttttagagctgtgctgaaaaacacagcgagttaaaataaggctttgtccgtacacaacttgtaaaagtgagcaccgattcggtgcttttttatttgct

SEQ ID NO: 325 - DNA, 97 bp, synthetic construct
  source 1..97: mol_type = other DNA
gttttagagctgtgctgaaaaacacagcgagttaaaataaggctttgtccgtacacaacttgaaaaagtgagcaccgattcggtgctttttcttttt

SEQ ID NO: 326 - DNA, 100 bp, synthetic construct
  source 1..100: mol_type = other DNA
gttttagagctgtgctgaaaaacacagcgagttaaaataaggctttgtccgtacacaacttgaaaaagtgcgcaccgattcggtgcttttttgttatttt

SEQ ID NO: 327 - DNA, 102 bp, synthetic construct
  source 1..102: mol_type = other DNA
gttttagagctgtgctgaaaaacacagcaagttaaaataaggctttgtccgtacacaacttgaaaaagtggcaccgattcggtgcttttttgttttatgccc

SEQ ID NO: 328 - DNA, 105 bp, synthetic construct
  source 1..105: mol_type = other DNA
gttttagagctgtgttgaaaaacacagcgagttaaaataaggctttgtccgtacacaacttgaaaaagtgagcaccgattcggtgcttttttgttttatgcctca

SEQ ID NO: 329 - DNA, 100 bp, synthetic construct
  source 1..100: mol_type = other DNA
gttttagagctgtgctgaaaaacacagtgagttaaaataaggctttgtccgtacacaacttgaaaaagtgagcaccgattcggtgcttttttgttgctca

SEQ ID NO: 330 - DNA, 102 bp, synthetic construct
  source 1..102: mol_type = other DNA
gttttagagctgtgctgaaaaacacagcgagttaaaataaggctttgtccgtacacacaacttgaaaaagtgcgcaccgattcggtgcttttttgttttctt

SEQ ID NO: 331 - DNA, 100 bp, synthetic construct
  source 1..100: mol_type = other DNA
gttttagagctgtgctgaaaaacacagcgagttaaaataaggtttagtccgtacacaacttgaaaaagtgagcaccgattcggtgcttttttgttttctt

SEQ ID NO: 332 - DNA, 100 bp, synthetic construct
  source 1..100: mol_type = other DNA
gttttagagctgtgctgaaaaacacagcgagttaaaataaggctttgtccgtacacaacttgtttaagtgcgcaccgattcggtgcttttttgttttata

SEQ ID NO: 333 - DNA, 100 bp, synthetic construct
  source 1..100: mol_type = other DNA
gttttagagctgtgctgaaaaacacagttagttaaaataaggctttgtccgtacacaacttgaaaaagtgagcaccgattcggtgcttttttgttttctt

SEQ ID NO: 334 - DNA, 101 bp, synthetic construct
  source 1..101: mol_type = other DNA
gttttagagctgtgttgaaaaacatagcaagttaaaataaggctttgtccgtacacaacttgaaaaagtgcgcaccgattcggtgcttttttgttttacta

SEQ ID NO: 335 - DNA, 102 bp, synthetic construct
  source 1..102: mol_type = other DNA
gttttagagctgtgctgaaaaacacagcgagttaaaataaggctttgtccgtacacaacttttgaaaaagtgcgcaccgattcggtgcttttttgttttatt

SEQ ID NO: 336 - DNA, 101 bp, synthetic construct
  source 1..101: mol_type = other DNA
gttttagagctgtgctgaaaaacacagcgagttaaaataaggctttgtccgtacacaacttgaaaaagtgagcaccgattcggtgcttttttattttgact

SEQ ID NO: 337 - DNA, 100 bp, synthetic construct
  source 1..100: mol_type = other DNA
gttttagagctgtgctgaaaaacacagcgagttaaaataaggctttgtccgtacacaacttgttaaagtggcacccgattcgggtgcttttttattttct

SEQ ID NO: 338 - DNA, 100 bp, synthetic construct
  source 1..100: mol_type = other DNA
gttttagagctgtgttgaaaaacacagtgagttaaaataaggctttgtccgtacacaacttaaaaaagtggcacccgattcgggtgctttttttattttc

SEQ ID NO: 339 - DNA, 102 bp, synthetic construct
  source 1..102: mol_type = other DNA
gttttagagctgtgctgaaaaacacagcgagttaaaataaggctttgtccgtacacaacttaaaaaagtggcacccgattcgggtgctttttttattttaaa

SEQ ID NO: 340 - DNA, 102 bp, synthetic construct
  source 1..102: mol_type = other DNA
gttttagagctgtgctgaaaaacacagcaagttaaaataaggctttgtccgtacacaacttgtaaaagtggcacccgattcggatgcgttttttatttgtgt

SEQ ID NO: 341 - DNA, 101 bp, synthetic construct
  source 1..101: mol_type = other DNA
gttttagagctgtgctgaaaaacacagcaagttaaaataaggctttgtccgtacacaacttaaaaaagtggcacccgattcgggtgcattttttgtgcttt

SEQ ID NO: 342 - DNA, 101 bp, synthetic construct
  source 1..101: mol_type = other DNA
gttttagagctgtgctgaaaaacacagcaagttaaaataaggctttgtccgtacacaacttgtaaaagtggcacccgattcgggtgcttttttattttatt

SEQ ID NO: 343 - DNA, 99 bp, synthetic construct
  source 1..99: mol_type = other DNA
gttttagagctgtgctgaaaaacacagcaagttaaaataaggctttgtccgtacacaacttaaaaaagtgagcaccgattcggtgcttttttattttct

SEQ ID NO: 344 - DNA, 100 bp, synthetic construct
  source 1..100: mol_type = other DNA
gttttagagctgtgctgaaaaacacagcaagttaaaataaggctttgtccgtacacaacttgtgaaagtaagcaccgattcggtgcttttttgttttcta

SEQ ID NO: 345 - DNA, 100 bp, synthetic construct
  source 1..100: mol_type = other DNA
gttttagagctgtgttgaaaaacacagcaagttaaaataaggctttgtccgtacacaacttgaaaaagtgagcaccgattcggtgctttttttgtgcctt

SEQ ID NO: 346 - DNA, 102 bp, synthetic construct
  source 1..102: mol_type = other DNA
gttttagagctgtgttgaaaaacacagcgagttaaaataaggctttgtccgtacacaacttgtaaaagtggcacccgattcgggtgctttttttatttttct

SEQ ID NO: 347 - DNA, 101 bp, synthetic construct
  source 1..101: mol_type = other DNA
gttttagagctgtgctgaaaaacacagcgagttaaaataaggctttgtccgtacacaacttgtaaaagtggcacccgattcgggtgccttttaattttctt

SEQ ID NO: 348 - DNA, 101 bp, synthetic construct
  source 1..101: mol_type = other DNA
gttttagagctgtgctgaaaaacacagtgagttaaaataaggctttgtccgtacacaacttgtaaaagtggcacccgattcgggtgcattttttattttct

SEQ ID NO: 349 - DNA, 100 bp, synthetic construct
  source 1..100: mol_type = other DNA
gttttagagctgtgctgaaaaacacagcgagttaaaataaggctttgtccgtacacaacttataaaagtgcgcaccgattcggtgcttttttattttatt

SEQ ID NO: 350 - DNA, 102 bp, synthetic construct
  source 1..102: mol_type = other DNA
gttttagagctgtgctgaaaaacacagcaagttaaaataaggctttgtccgtacacaacttaaaaaagtggcacccgattcggatgcgttttttgtgtacat

SEQ ID NO: 351 - DNA, 101 bp, synthetic construct
  source 1..101: mol_type = other DNA
gttttagagctgtgctgaaaaacacagcgagttaaaataaggctttgtccgtacacaacttgtaaaagtgagcaccgattcggtgcttttttattttttct

SEQ ID NO: 352 - DNA, 100 bp, synthetic construct
  source 1..100: mol_type = other DNA
gttttagagctgtgttgaaaaacacagcgagttaaaataaggctttgtccgtacacaacttgtaaaagtgagcaccgattcggtgcttttttattttatt

SEQ ID NO: 353 - DNA, 99 bp, synthetic construct
  source 1..99: mol_type = other DNA
gttttagagctgtgctgaaaaacacagcgagttaaaataaggctttgtccgtacacaacttgtaaaagtgagcaccgattcggtgcttttttgttgaca

SEQ ID NO: 354 - DNA, 101 bp, synthetic construct
  source 1..101: mol_type = other DNA
gttttagagctgtgctgaaaaacacagcaagttaaaataaggctttgtccgtacacaacttgtaaaagtggcacccgattcgggtgcatttttttgtgtgt

SEQ ID NO: 355 - DNA, 100 bp, synthetic construct
  source 1..100: mol_type = other DNA
gttttagagctgtgttgaaaaacacagcaagttaaaataaggctttgtccgtacacaacttgaaaaagtgcgcaccgattcggtgcttttttgttgcgta

SEQ ID NO: 356 - DNA, 103 bp, synthetic construct
  source 1..103: mol_type = other DNA
gttttagagctgtgttgaaaaacacagcgagttaaaataaggctttgtccgtacacaacttgtaaaagtggcacccgattcgggtgcattttttattttaaca

SEQ ID NO: 357 - DNA, 101 bp, synthetic construct
  source 1..101: mol_type = other DNA
gttttagagctgtgctgaaaaacacagtgagttaaaataaggctttgtccgtacacaacttgtaaaaggtgcgcaccgattcggtgctttttttattttct

SEQ ID NO: 358 - DNA, 100 bp, synthetic construct
  source 1..100: mol_type = other DNA
gttttagagctgtgttgaaaaacacagcgagttaaaataaggctttgtccgtacacattttggcaaagtgagcaccgattcggtgcttttttattttatt

SEQ ID NO: 359 - DNA, 101 bp, synthetic construct
  source 1..101: mol_type = other DNA
gttttagagctgtgctgaaaaacacagcaagttaaaataaggctttgtccgtacacaacttaaaaaagtggcaccccgattcggtgctttttttattttct

SEQ ID NO: 360 - DNA, 101 bp, synthetic construct
  source 1..101: mol_type = other DNA
gttttagagctgtgctgaaaaacacagcgagttaaaataaggctagtccgtatccaacttgaaaaagtggcaccccgattcggatgcattttttatttgtg

SEQ ID NO: 361 - DNA, 99 bp, synthetic construct
  source 1..99: mol_type = other DNA
gttttagagctgtgctgaaaaacacagcgagttaaaataaggctttgtccgtacacaacttgtaaaagtggcacccgattcggtgcttttttatttctt

SEQ ID NO: 362 - DNA, 101 bp, synthetic construct
  source 1..101: mol_type = other DNA
gttttagagctgtgctgaaaaacacagcgagttaaaataaggctttgtccgtacacaacttgtaaaagtgagcaccgattcggtgtttttttattttaaca

SEQ ID NO: 363 - DNA, 100 bp, synthetic construct
  source 1..100: mol_type = other DNA
gttttagagctgtgctgaaaaacacagcgagttaaaataaggctttgtccgtacacaacttgaaaaagtggcacccgattcgggtgcattttttgtgtgt

SEQ ID NO: 364 - DNA, 100 bp, synthetic construct
  source 1..100: mol_type = other DNA
gttttagagctgtgctgaaaaacacagcgagttaaaataaggctagtccgtacacaacttgtgaaagtggcacccgattcgggtgcattttttattttct

SEQ ID NO: 365 - DNA, 102 bp, synthetic construct
  source 1..102: mol_type = other DNA
gttttagagctgtgttgaaaaacacagcgagttaaaataaggctttgtccgtacacaacttttgaaaaagtgcgcaccgattcggtgcttttttattttatt

SEQ ID NO: 366 - DNA, 101 bp, synthetic construct
  source 1..101: mol_type = other DNA
gttttagagctgtgttgaaaaacacagcaagttaaaataaggctttgtccgtatccaacttgaaaaagtgcgcaccgattcggtgcttttttgttttacta

SEQ ID NO: 367 - DNA, 101 bp, synthetic construct
  source 1..101: mol_type = other DNA
gttttagagctgtgctgaaaaacacagcaagttaaaataaggctttgtccgtacacaacttgtaaaagtggcacccgattcgggtgcgttttttattttct

SEQ ID NO: 368 - DNA, 101 bp, synthetic construct
  source 1..101: mol_type = other DNA
gttttagagctgtgctgaaaaacacagtgagttaaaataaggctttgtccgtacacaacttgtaaaagtgagcaccgattcggtgctttttttattttact

SEQ ID NO: 369 - DNA, 101 bp, synthetic construct
  source 1..101: mol_type = other DNA
gttttagagctgtgctgaaaaacacagcaagttaaaataaggctttgtccgtacacaacttgtaaaagtgagcaccgattcggtgctttttttatttttct

SEQ ID NO: 370 - DNA, 101 bp, synthetic construct
  source 1..101: mol_type = other DNA
gttttagagctgtgctgaaaaacacagcaagttaaaataaggctttgtccgtacacaacttaaaaaagtggcacccgattcgggtgcattttttattttct

SEQ ID NO: 371 - DNA, 99 bp, synthetic construct
  source 1..99: mol_type = other DNA
gttttagagctgtgctgaaaaacacagtgagttaaaataaggctttgtccgtacacaacttgtgaaagtacgcaccgattcggtgctttttttattttc

SEQ ID NO: 372 - DNA, 93 bp, synthetic construct
  source 1..93: mol_type = other DNA
gttttagagctgtgctgaaaaacacagcaagttaaaataaggctttgtccgtacacaacttgtaaaaggagcgccgatgctttttttgtgccc

SEQ ID NO: 373 - DNA, 101 bp, synthetic construct
  source 1..101: mol_type = other DNA
gttttagagctgtgctgaaaaacacagtgagttaaaataaggctttgtccgtacacaacttgtaaaagtggcacccaattcgggtgcgttttttattttct

SEQ ID NO: 374 - DNA, 102 bp, synthetic construct
  source 1..102: mol_type = other DNA
gttttagagctgtgctgaaaaacacagcaagttaaaataaggctttgtccgtacacaacttgtaaaaggtgcgcaccgattcggtgtttttttattttacca

SEQ ID NO: 375 - DNA, 93 bp, synthetic construct
  source 1..93: mol_type = other DNA
gttttagagctgtgctgaaaaacacagcaagttaaaataaggctttgtccgtacacattttggccccccgattcgggtgcgttttttgtgccc

SEQ ID NO: 376 - DNA, 101 bp, synthetic construct
  source 1..101: mol_type = other DNA
gttttagagctgtgctgaaaaacacagcaagttaaaataaggctttgtccgtacacaacttgtaaaagtggcacccgattcggatgcattttttattgtgg

SEQ ID NO: 377 - DNA, 100 bp, synthetic construct
  source 1..100: mol_type = other DNA
gttttagagctgtgttgaaaaacacagcaagttaaaataaggctttgtccgtacacaacttgaaaaagtgagcaccgattcggtgcttttttgttgcgta

SEQ ID NO: 378 - DNA, 99 bp, synthetic construct
  source 1..99: mol_type = other DNA
gttttagagctgtgctgaaaaacacagcaagttaaaataaggctttgtccgtacacaacttgtgaaagtacgcaccgattcggtgctttttttatttac

SEQ ID NO: 379 - DNA, 102 bp, synthetic construct
  source 1..102: mol_type = other DNA
gttttagagctgtgctgaaaaacacagcaagttaaaataaggctttgtccgtacacaacttgtaaaagtggcaccccgattcgggtgcgtttttttgtgccc

SEQ ID NO: 380 - DNA, 101 bp, synthetic construct
  source 1..101: mol_type = other DNA
gttttagagctgtgctgaaaaacacagcaagttaaaataaggctttgtccgtacacaacttaaaaaagtggcgccccgattcggtgctttttttattgtgt

SEQ ID NO: 381 - DNA, 103 bp, synthetic construct
  source 1..103: mol_type = other DNA
gttttagagctgtgctgaaaaacacagcaagttaaaataaggctttgtccgtacacaacttgtaaaagtggcacccaattcgggtgcgtttttttatttctct

SEQ ID NO: 382 - DNA, 100 bp, synthetic construct
  source 1..100: mol_type = other DNA
gttttagagctgtgttgaaaaacacagcaagttaaaataaggctttgtccgtacacaacttgaaaaagtgagcaccgattcggtgctttttattttatta

SEQ ID NO: 383 - protein, 4 aa, synthetic construct
KRKR

SEQ ID NO: 384 - protein, 4 aa, synthetic construct
KRRR

SEQ ID NO: 385 - protein, 4 aa, synthetic construct
KKRK

SEQ ID NO: 386 - protein, 4 aa, synthetic construct
KRRK

SEQ ID NO: 387 - protein, 7 aa, synthetic construct
  VARIANT 7: note = X is any amino acid except Asp or Glu
RXXKRKX

SEQ ID NO: 388 - protein, 7 aa, synthetic construct
  VARIANT 7: note = X is any amino acid except Asp or Glu
PXXKRKX

SEQ ID NO: 389 - protein, 7 aa, synthetic construct
  VARIANT 7: note = X is any amino acid except Asp or Glu
RXXKRRX

SEQ ID NO: 390 - protein, 7 aa, synthetic construct
  VARIANT 7: note = X is any amino acid except Asp or Glu
PXXKRRX

SEQ ID NO: 391 - protein, 7 aa, synthetic construct
  VARIANT 6: note = X is any amino acid except Asp or Glu
RXXKRXK

SEQ ID NO: 392 - protein, 7 aa, synthetic construct
  VARIANT 6: note = X is any amino acid except Asp or Glu
PXXKRXK

SEQ ID NO: 393 - protein, 7 aa, synthetic construct
  VARIANT 6: note = X is any amino acid except Asp or Glu
RXXKRXR

SEQ ID NO: 394 - protein, 7 aa, synthetic construct
  VARIANT 6: note = X is any amino acid except Asp or Glu
PXXKRXR

SEQ ID NO: 395 - protein, 8 aa, synthetic construct
KRXWXXAF

SEQ ID NO: 396 - protein, 8 aa, synthetic construct
KRXFXXAF

SEQ ID NO: 397 - protein, 8 aa, synthetic construct
KRXYXXAF

SEQ ID NO: 398 - protein, 6 aa, synthetic construct
  VARIANT 6: note = X is W, F, or Y
LGKRRX

SEQ ID NO: 399 - protein, 6 aa, synthetic construct
  VARIANT 6: note = X is W, F, or Y
LGKRKX

SEQ ID NO: 400 - RNA, 20 nt, synthetic construct
  source 1..20: mol_type = other RNA
ggcccagactgagcacgtga

SEQ ID NO: 401 - RNA, 20 nt, synthetic construct
  source 1..20: mol_type = other RNA
acatacttctgtaatacact

SEQ ID NO: 402 - RNA, 20 nt, synthetic construct
  source 1..20: mol_type = other RNA
gaacacaaagcatagactgc

SEQ ID NO: 403 - RNA, 20 nt, synthetic construct
  source 1..20: mol_type = other RNA
gagcagatcgttgattgtag

SEQ ID NO: 404 - DNA, 20 bp, synthetic construct
  source 1..20: mol_type = other DNA
atgtgggctgcctagaaagg

SEQ ID NO: 405 - DNA, 20 bp, synthetic construct
  source 1..20: mol_type = other DNA
cccagccaaacttgtcaacc

SEQ ID NO: 406 - DNA, 20 bp, synthetic construct
  source 1..20: mol_type = other DNA
gacgcagatattggcgtcac

SEQ ID NO: 407 - DNA, 24 bp, synthetic construct
  source 1..24: mol_type = other DNA
ggaagcccatgtagtctaactacc

SEQ ID NO: 408 - DNA, 23 bp, synthetic construct
  source 1..23: mol_type = other DNA
ctggtggtacttgaatcaagcac

SEQ ID NO: 409 - DNA, 26 bp, synthetic construct
  source 1..26: mol_type = other DNA
gaaggagacttgtgcacattctatag

SEQ ID NO: 410 - protein, 147 aa, synthetic construct
MDDQGWMKLALEEARASRAAGEVPVGAVVVRDGQIVASAGNRTRELCDPTAHAEIVALRQAARALGNYRLPGCTLYVTLEPCAMCAGAMVHARLDRLVYGVPNPKAGAAGSVLDVLHHPRLNHRLEVTGGVLEDECGALLRDFFRAR

SEQ ID NO: 411 - protein, 149 aa, synthetic construct
MDPEDVAFMRKALDEARKAREAGEVPVGAVVVKDGEIVARAHNRTIQKSDPTAHAEILALRKAARALGNYRLTGCTLYATLEPCAMCAGAILHARIERLVYGVPNPKAGATGSVLNVLNHPRLNHRVEVTGGVLAEECGALLRGFFRAR

SEQ ID NO: 412 - DNA, 76 bp, synthetic construct
  source 1..76: mol_type = other DNA
gttttagagctagaaatagcaagttaaaataaggctagtccgttatcaacttgaaaaagtggcaccgagtcggtgc

SEQ ID NO: 413 - RNA, 20 nt, synthetic construct
  source 1..20: mol_type = other RNA
ggggccactagggacaggat

SEQ ID NO: 414 - RNA, 20 nt, synthetic construct
  source 1..20: mol_type = other RNA
ggggccactagggacaggat

SEQ ID NO: 415 - RNA, 20 nt, synthetic construct
  source 1..20: mol_type = other RNA
ggggccactagggacaggat

SEQ ID NO: 416 - RNA, 20 nt, synthetic construct
  source 1..20: mol_type = other RNA
ggggccactagggacaggat

SEQ ID NO: 417 - RNA, 20 nt, synthetic construct
  source 1..20: mol_type = other RNA
ggaatcccttctgcagcacc

SEQ ID NO: 418 - RNA, 20 nt, synthetic construct
  source 1..20: mol_type = other RNA
ggaatcccttctgcagcacc

SEQ ID NO: 419 - RNA, 20 nt, synthetic construct
  source 1..20: mol_type = other RNA
ggaatcccttctgcagcacc

SEQ ID NO: 420 - RNA, 20 nt, synthetic construct
  source 1..20: mol_type = other RNA
ggaatcccttctgcagcacc

SEQ ID NO: 421 - RNA, 20 nt, synthetic construct
  source 1..20: mol_type = other RNA
gggtggggggagtttgctcc

SEQ ID NO: 422 - RNA, 20 nt, synthetic construct
  source 1..20: mol_type = other RNA
gggtggggggagtttgctcc

SEQ ID NO: 423 - RNA, 20 nt, synthetic construct
  source 1..20: mol_type = other RNA
gggtggggggagtttgctcc

SEQ ID NO: 424 - RNA, 20 nt, synthetic construct
  source 1..20: mol_type = other RNA
gggtggggggagtttgctcc

SEQ ID NO: 425 - RNA, 20 nt, synthetic construct
  source 1..20: mol_type = other RNA
gaacacaaagcatagactgc

SEQ ID NO: 426 - RNA, 20 nt, synthetic construct
  source 1..20: mol_type = other RNA
gaacacaaagcatagactgc

SEQ ID NO: 427 - RNA, 20 nt, synthetic construct
  source 1..20: mol_type = other RNA
gaacacaaagcatagactgc

SEQ ID NO: 428 - RNA, 20 nt, synthetic construct
  source 1..20: mol_type = other RNA
ggcccagactgagcacgtga

SEQ ID NO: 429 - RNA, 20 nt, synthetic construct
  source 1..20: mol_type = other RNA
ggcccagactgagcacgtga

SEQ ID NO: 430 - RNA, 20 nt, synthetic construct
  source 1..20: mol_type = other RNA
ggcccagactgagcacgtga

SEQ ID NO: 431 - RNA, 20 nt, synthetic construct
  source 1..20: mol_type = other RNA
ggcccagactgagcacgtga

SEQ ID NO: 432 - RNA, 20 nt, synthetic construct
  source 1..20: mol_type = other RNA
ggacagcttttcctagacag

SEQ ID NO: 433 - DNA, 22 bp, synthetic construct
  source 1..22: mol_type = other DNA
gcctgtgatgggctaattgatg

SEQ ID NO: 434 - DNA, 21 bp, synthetic construct
  source 1..21: mol_type = other DNA
gtctctgaccactgcgatatg

SEQ ID NO: 435 - DNA, 52 bp, synthetic construct
  source 1..52: mol_type = other DNA
cactctttccctacacgacgctcttccgatctacaggaggtgggggttagac

SEQ ID NO: 436 - DNA, 48 bp, synthetic construct
  source 1..48: mol_type = other DNA
ggagttcagacgtgtgctcttccgatctcggttaatgtggctctggtt

SEQ ID NO: 437 - DNA, 52 bp, synthetic construct
  source 1..52: mol_type = other DNA
cactctttccctacacgacgctcttccgatctaacaccaccactgcttaccc

SEQ ID NO: 438 - DNA, 48 bp, synthetic construct
  source 1..48: mol_type = other DNA
ggagttcagacgtgtgctcttccgatcttccattaagttccaggggtg

SEQ ID NO: 439 - DNA, 52 bp, synthetic construct
  source 1..52: mol_type = other DNA
cactctttccctacacgacgctcttccgatctagaggtcaccctcaccacac

SEQ ID NO: 440 - DNA, 48 bp, synthetic construct
  source 1..48: mol_type = other DNA
ggagttcagacgtgtgctcttccgatcttgttcacagcttgtaggcca

SEQ ID NO: 441 - DNA, 52 bp, synthetic construct
  source 1..52: mol_type = other DNA
cactctttccctacacgacgctcttccgatctcttggctccttcgttacagc

SEQ ID NO: 442 - DNA, 48 bp, synthetic construct
  source 1..48: mol_type = other DNA
ggagttcagacgtgtgctcttccgatctggtagatgggcaaccaactc

SEQ ID NO: 443 - DNA, 51 bp, synthetic construct
  source 1..51: mol_type = other DNA
cactctttccctacacgacgctcttccgatctcttgcctccactggttgtg

SEQ ID NO: 444 - DNA, 46 bp, synthetic construct
  source 1..46: mol_type = other DNA
ggagttcagacgtgtgctcttccgatctgccgtctccaaggtgaaa

SEQ ID NO: 445 - DNA, 53 bp, synthetic construct
  source 1..53: mol_type = other DNA
cactctttccctacacgacgctcttccgatctgcctgctgcactctctgagta

SEQ ID NO: 446 - DNA, 48 bp, synthetic construct
  source 1..48: mol_type = other DNA
ggagttcagacgtgtgctcttccgatctcacagattgatgccactgga

SEQ ID NO: 447 - DNA, 50 bp, synthetic construct
  source 1..50: mol_type = other DNA
cactctttccctacacgacgctcttccgatctcgaactcctggggcttct

SEQ ID NO: 448 - DNA, 46 bp, synthetic construct
  source 1..46: mol_type = other DNA
ggagttcagacgtgtgctcttccgatctgtggggagggagagcagt

SEQ ID NO: 449 - DNA, 52 bp, synthetic construct
  source 1..52: mol_type = other DNA
cactctttccctacacgacgctcttccgatctgtgacccaggtccagtgttt

SEQ ID NO: 450 - DNA, 48 bp, synthetic construct
  source 1..48: mol_type = other DNA
ggagttcagacgtgtgctcttccgatcttgagacctctgacctccaca

SEQ ID NO: 451 - DNA, 52 bp, synthetic construct
  source 1..52: mol_type = other DNA
cactctttccctacacgacgctcttccgatctccagatggcacattgtcaga

SEQ ID NO: 452 - DNA, 48 bp, synthetic construct
  source 1..48: mol_type = other DNA
ggagttcagacgtgtgctcttccgatctgctaaagagggaatgggctt

SEQ ID NO: 453 - DNA, 52 bp, synthetic construct
  source 1..52: mol_type = other DNA
cactctttccctacacgacgctcttccgatctcatcaggcaatgagtcagga

SEQ ID NO: 454 - DNA, 48 bp, synthetic construct
  source 1..48: mol_type = other DNA
ggagttcagacgtgtgctcttccgatcttcttaggaggttgggtgtgc

SEQ ID NO: 455 - DNA, 52 bp, synthetic construct
  source 1..52: mol_type = other DNA
cactctttccctacacgacgctcttccgatcttctatcctttccaagggcaa

SEQ ID NO: 456 - DNA, 48 bp, synthetic construct
  source 1..48: mol_type = other DNA
ggagttcagacgtgtgctcttccgatcttcaataacaaggctcccagg

SEQ ID NO: 457 - DNA, 52 bp, synthetic construct
  source 1..52: mol_type = other DNA
cactctttccctacacgacgctcttccgatctgtgaagcgtgacactccctt

SEQ ID NO: 458 - DNA, 49 bp, synthetic construct
  source 1..49: mol_type = other DNA
ggagttcagacgtgtgctcttccgatcttgctcagtccagagctcttct

SEQ ID NO: 459 - DNA, 52 bp, synthetic construct
  source 1..52: mol_type = other DNA
cactctttccctacacgacgctcttccgatctccagccccatctgtcaaact

SEQ ID NO: 460 - DNA, 53 bp, synthetic construct
  source 1..53: mol_type = other DNA
ggagttcagacgtgtgctcttccgatcttgaatggattccttggaaacaatga

SEQ ID NO: 461 - DNA, 53 bp, synthetic construct
  source 1..53: mol_type = other DNA
cactctttccctacacgacgctcttccgatctgtgtggagagtgagtaagcca

SEQ ID NO: 462 - DNA, 49 bp, synthetic construct
  source 1..49: mol_type = other DNA
ggagttcagacgtgtgctcttccgatctacggtaggatgatttcaggca

SEQ ID NO: 463 - DNA, 57 bp, synthetic construct
  source 1..57: mol_type = other DNA
cactctttccctacacgacgctcttccgatcttttttggtactcgagtgttattcag

SEQ ID NO: 464 - DNA, 49 bp, synthetic construct
  source 1..49: mol_type = other DNA
ggagttcagacgtgtgctcttccgatctcacaaagcagtgtagctcagg

SEQ ID NO: 465 - DNA, 52 bp, synthetic construct
  source 1..52: mol_type = other DNA
cactctttccctacacgacgctcttccgatctatgtgggctgcctagaaagg

SEQ ID NO: 466 - DNA, 48 bp, synthetic construct
  source 1..48: mol_type = other DNA
ggagttcagacgtgtgctcttccgatctcccagccaaacttgtcaacc

SEQ ID NO: 467 - DNA, 52 bp, synthetic construct
  source 1..52: mol_type = other DNA
cactctttccctacacgacgctcttccgatcttcccctgttgacctggagaa

SEQ ID NO: 468 - DNA, 48 bp, synthetic construct
  source 1..48: mol_type = other DNA
ggagttcagacgtgtgctcttccgatctcactgtacttgccctgacca

SEQ ID NO: 469 - DNA, 52 bp, synthetic construct
  source 1..52: mol_type = other DNA
cactctttccctacacgacgctcttccgatctttggtgttgacagggagcaa

SEQ ID NO: 470 - DNA, 48 bp, synthetic construct
  source 1..48: mol_type = other DNA
ggagttcagacgtgtgctcttccgatctctgagatgtgggcagaaggg

SEQ ID NO: 471 - DNA, 52 bp, synthetic construct; identical to SEQ ID NO: 469
  source 1..52: mol_type = other DNA

SEQ ID NO: 472 - DNA, 48 bp, synthetic construct; identical to SEQ ID NO: 470
  source 1..48: mol_type = other DNA

SEQ ID NO: 473 - DNA, 52 bp, synthetic construct
  source 1..52: mol_type = other DNA
cactctttccctacacgacgctcttccgatcttgagagggaacagaagggct

SEQ ID NO: 474 - DNA, 48 bp, synthetic construct
  source 1..48: mol_type = other DNA
ggagttcagacgtgtgctcttccgatctgtccaaaggcccaagaacct

What is claimed is:

1. An engineered nuclease having an amino acid sequence with at least 90% identity to any one of SEQ ID NOs: 201, 202, 208, 212, 223, and 250.

2. The engineered nuclease of claim 1, wherein the engineered nuclease has an amino acid sequence with at least 95% identity to any one of SEQ ID NOs: 201, 202, 208, 212, 223, and 250.

3. The engineered nuclease of claim 1, wherein the engineered nuclease has an amino acid sequence of any one of SEQ ID NO: 201, 202, 208, 212, 223, and 250.

4. The engineered nuclease of claim 1, comprising one or more amino acid substitutions configured to fully or partially catalytically inactivate the engineered nuclease.

5. The engineered nuclease of claim 1, wherein the engineered nuclease further comprises a localization sequence, a tag sequence, a protein transduction domain sequence, or a combination thereof.

6. The engineered nuclease of claim 1, wherein the engineered nuclease has an amino acid sequence with at least 97% identity to any one of SEQ ID NOs: 201, 202, 208, 212, 223, and 250.

7. The engineered nuclease of claim 6, wherein the engineered nuclease has an amino acid sequence with at least 97% identity to SEQ ID NO: 201.

8. The engineered nuclease of claim 1, wherein the engineered nuclease has an amino acid sequence with at least 99% identity to any one of SEQ ID NOs: 201, 202, 208, 212, 223, and 250.

9. The engineered nuclease of claim 3, wherein the engineered nuclease has an amino acid sequence of SEQ ID NO: 201.

10. A fusion protein comprising an engineered nuclease of claim 1 and one or more effector domains.

11. The fusion protein of claim 10, wherein the one or more effector domains are each individually selected from the group consisting of: a transcription activator, a transcription repressor, a deaminase, a polymerase, an epigenetic modifier, and a detection agent.

12. The fusion protein of claim 10, comprising one or more amino acid substitutions configured to fully or partially catalytically inactivate the engineered nuclease.

13. A fusion protein comprising the engineered nuclease of claim 9 and one or more effector domains.

14. A cell comprising an engineered nuclease of claim 1 or a fusion protein thereof.

15. The cell of claim 14, wherein the cell is a prokaryotic cell or a eukaryotic cell.

16. A cell comprising the engineered nuclease of claim 9 or a fusion protein thereof.

17. A nucleic acid encoding the engineered nuclease of claim 1 or a fusion protein thereof.

18. A nucleic acid encoding the engineered nuclease of claim 9 or a fusion protein thereof.

19. A system comprising an engineered nuclease of claim 1, and/or a fusion protein thereof, and at least one guide RNA, or one or more nucleic acids encoding thereof.

20. The system of claim 19, wherein the at least one guide RNA (gRNA) is complexed with the nuclease.

21. A system comprising the engineered nuclease of claim 9, and/or a fusion protein thereof, and at least one guide RNA, or one or more nucleic acids encoding thereof.

22. A method of modifying a target nucleic acid comprising contacting the target nucleic acid with; an engineered nuclease of claim 1 and/or a fusion protein thereof; and at least one guide RNA.

23. The method of claim 22, wherein the target nucleic acid is associated with a disease or disorder.

24. The method of claim 22, wherein the target nucleic acid encodes a gene product.

25. The method of claim 24, wherein the target nucleic acid is a disease-associated gene.

26. The method of claim 22, wherein the target nucleic acid is in a cell and the contacting comprises introducing the engineered nuclease, and/or a fusion protein thereof, and at least one guide RNA, or one or more nucleic acids encoding the engineered nuclease, and/or a fusion protein thereof, and the at least one guide RNA into the cell.

27. The method of claim 26, wherein the cell is in vivo, in vitro, or ex vivo.

28. The method of claim 27, wherein the introducing comprises administering to a subject.

29. A method of modifying a target nucleic acid comprising contacting the target nucleic acid with: the engineered nuclease of claim 9 and/or a fusion protein thereof; and at least one guide RNA.

30. The method of claim 29, wherein the target nucleic acid is in a cell and the contacting comprises introducing the engineered nuclease, and/or a fusion protein thereof, and at least one guide RNA, or one or more nucleic acids encoding the engineered nuclease, and/or a fusion protein thereof, and the at least one guide RNA, into the cell.

* * * * *